United States Patent
Dudek et al.

(10) Patent No.: US 11,655,473 B2
(45) Date of Patent: May 23, 2023

(54) COMPOSITIONS AND METHODS FOR INHIBITING MITOCHONDRIA AMIDOXIME REDUCING COMPONENT 1 (MARC1) EXPRESSION

(71) Applicants: Novo Nordisk A/S, Bagsvaerd (DK); Dicerna Pharmaceuticals, Inc., Lexington, MA (US)

(72) Inventors: Henryk Dudek, Belmont, MA (US); Wen Han, Boston, MA (US); Natalie Wayne Pursell, Westborough, MA (US); Chengjung Lai, Hudson, NH (US); William Geoffrey Haynes, Oxford (GB); Zhihao Ding, Biberach an der Riss (DE)

(73) Assignees: Novo Nordisk A/S, Bagsvaerd (DK); Dicerna Pharmaceuticals, Inc., Lexington, MA (US)

(*) Notice: Subject to any disclaimer, the term of this patent is extended or adjusted under 35 U.S.C. 154(b) by 0 days.

(21) Appl. No.: 17/826,211

(22) Filed: May 27, 2022

(65) Prior Publication Data

US 2023/0042451 A1    Feb. 9, 2023

Related U.S. Application Data

(60) Provisional application No. 63/194,395, filed on May 28, 2021.

(30) Foreign Application Priority Data

Jul. 6, 2021 (EP) .................................... 21183860

(51) Int. Cl.
C12N 15/113  (2010.01)
A61P 1/16  (2006.01)

(52) U.S. Cl.
CPC ............ *C12N 15/1137* (2013.01); *A61P 1/16* (2018.01); *C12N 2310/14* (2013.01); *C12N 2310/315* (2013.01); *C12N 2310/321* (2013.01); *C12N 2310/351* (2013.01); *C12N 2310/531* (2013.01)

(58) Field of Classification Search
CPC ............ C12N 15/1137; C12N 2310/14; C12N 2310/315; C12N 2310/321; C12N 2310/322; C12N 2310/531; C12N 2310/3515
USPC .................... 435/6.1, 91.1, 91.31, 455, 458; 514/44 A; 536/23.1, 24.5
See application file for complete search history.

(56) References Cited

U.S. PATENT DOCUMENTS

| 7,820,809 | B2 | 10/2010 | Khvorova et al. |
| 8,090,542 | B2 | 1/2012 | Khvorova et al. |
| 10,835,581 | B2 | 11/2020 | Gladwin et al. |
| 2005/0245475 | A1 | 11/2005 | Khvorova et al. |
| 2005/0255487 | A1 | 11/2005 | Khvorova et al. |
| 2020/0108073 | A1 | 4/2020 | Gallo et al. |
| 2020/0241005 | A1 | 7/2020 | Miner et al. |
| 2021/0038698 | A1 | 2/2021 | Gladwin et al. |

FOREIGN PATENT DOCUMENTS

| WO | 2006006948 A2 | 1/2006 |
| WO | 2016100401 A1 | 6/2016 |

OTHER PUBLICATIONS

Bessone et al., "Molecular pathways of nonalcoholic fatty liver disease development and progression" Cell Mol Life Sci, Jan. 2019, vol. 76, No. 1, pp. 99-128.
Chalasani et al., "The diagnosis and management of non-alcoholic fatty liver disease: practice Guideline by the American Association for the Study of Liver Diseases, American College of Gastroenterology, and the American Gastroenterological Association", Hepatology, Jun. 2012, vol. 55, No. 6, pp. 2005-2023.
Emdin et al., "A missense variant in Mitochondrial Amidoxime Reducing Component 1 gene and protection against liver disease", bioRxiv, Mar. 31, 2019, pp. 1-18.
Haas et al., "Machine learning enables new insights into clinical significance of and genetic contributions to liver fat accumulation", medRxiv, Sep. 3, 2020, 33 pages.
Hudert et al., "Variants in MARC1 and HSD17B13 reduce severity of NAFLD in children, perturb phospholipid metabolism, and suppress fibrotic pathways", medRxiv, Jun. 7, 2020, 28 pages.
Innes et al., "Genome-Wide Association Study for Alcohol-Related Cirrhosis Identifies Risk Loci in MARC1 and HNRNPUL1", Gastroenterology, Oct. 2020, vol. 159, No. 4, pp. 1276-1289.
Klein et al., "The mitochondrial amidoxime-reducing component (mARC1) is a novel signal-anchored protein of the outer mitochondrial membrane", J Biol Chem., Dec. 2012, vol. 287, No. 51, pp. 42795-42803.
Loomba et al., "The global NAFLD epidemic", Nat Rev Gastroenterol Hepatol, Nov. 2013, vol. 10, No. 11, pp. 686-690.
Luukkonen et al., "MARC1 variant rs2642438 increases hepatic phosphatidylcholines and decreases severity of non-alcoholic fatty liver disease in humans", J Hepatol., Sep. 2020, vol. 73, No. 3, pp. 725-726.
Mann et al., "Insights into genetic variants associated with NASH-fibrosis from metabolite profiling", Human Molecular Genetics, Oct. 15, 2020, vol. 29, No. 20, pp. 3451-3463.

(Continued)

*Primary Examiner* — Jane J Zara
(74) *Attorney, Agent, or Firm* — Jianjie Hu

(57) ABSTRACT

Oligonucleotides are provided herein that inhibit MARC1 expression. Also provided are compositions including the same and uses thereof, particularly uses relating to treating diseases, disorders and/or conditions associated with MARC1 expression.

27 Claims, 12 Drawing Sheets

Specification includes a Sequence Listing.

(56) References Cited

OTHER PUBLICATIONS

Nakatsuji et al., "A commensal strain of *Staphylococcus epidermidis* protects against skin neoplasia", Science Advances, Feb. 2018, vol. 4, No. 2, pp. 1-9.
Ott et al., "Functional characterization of protein variants encoded by nonsynonymous single nucleotide polymorphisms in MARC1 and MARC2 in healthy Caucasians", Drug Metab Dispos., Apr. 2014, vol. 42, No. 4, pp. 718-725.
Plitzko et al., "The Pivotal Role of the Mitochondrial Amidoxime Reducing Component 2 in Protecting Human Cells against Apoptotic Effects of the Base Analog N6-Hydroxylaminopurine", J Biol Chem., Feb. 2015, vol. 290, No. 16, pp. 10126-10135.
Sparacino-Watkins et al., "Nitrite reductase and nitric-oxide synthase activity of the mitochondrial molybdopterin enzymes mARC1 and mARC2", J Biol Chem., Apr. 2014, vol. 289, No. 15, pp. 10345-10358.
U.S. Appl. No. 62/591,390, filed Nov. 28, 2017, 33 pages.
Vujkovic et al., "A genome-wide association study of chronic ALT-based non-alcoholic fatty liver disease in the Million Veteran Program with histological and radiological validation", medRxiv, Jul. 6, 2021, pp. 1-68.
Vujkovic et al., "A trans-ancestry genome-wide association study of unexplained chronic ALT elevation as a proxy for nonalcoholic fatty liver disease with histological and radiological validation", medRxiv, Aug. 25, 2021, pp. 1-71.

COMPOSITIONS AND METHODS FOR INHIBITING MITOCHONDRIA AMIDOXIME REDUCING COMPONENT 1 (MARC1) EXPRESSION

CROSS-REFERENCE TO RELATED APPLICATIONS

This application claims priority to European Patent Application 21183860.2, filed Jul. 6, 2021, and claims priority to U.S. Application 63/194,395, filed May 28, 2021; the contents of which are incorporated herein by reference.

SEQUENCE LISTING

The instant application contains a Sequence Listing which has been submitted in ASCII format via EFS-Web and is hereby incorporated by reference in its entirety. Said ASCII copy, created on May 26, 2022, is named 210009US02_SeqList.txt and is 726 kilobytes in size.

BACKGROUND OF INVENTION

The liver plays a critical role in the metabolism of lipids. Abnormalities in normal hepatic lipid metabolism are associated with the development of various liver diseases or disorders such as, non-alcoholic fatty liver disease (NAFLD), its subsequent progression to non-alcoholic steatohepatitis (NASH) and potentially other advanced liver abnormalities.

NAFLD is one of the most common liver diseases, with increasing prevalence worldwide (Loomba R., & Sanyal A. J. (2013) NAT REV GASTROENTEROL HEPATOL 10(11):686-90). NAFLD is characterized by a spectrum of clinical and pathological severity ranging from simple steatosis to nonalcoholic fatty liver (NAFL), nonalcoholic steatohepatitis (NASH), fibrosis, cirrhosis, hepatocellular carcinoma (HCC) and liver failure (Bessone F, et al., (2019) CELL MOL LIFE SCI 76(1):99-128). NAFLD is characterized as the presence of fat in the liver in the absence of significant alcohol consumption and other causes of fat in the liver such as medications, starvation, and viral disease (Chalasani, N., et al., (2012) HEPATOLOGY (Baltimore, Md.), 55(6), 2005-23). Additionally, as the disease progresses into NASH, patients also have an increased risk of developing extra-hepatic complications, particularly cardiovascular diseases (CVD), which are among the most common causes of death in this patient population. The abnormalities in hepatic lipid metabolism that lead to NAFLD also drive the progression of atherogenic dyslipidemia, where elevated plasma triglycerides (TG), cholesterol and lipoprotein particles infiltrate the arterial wall and subsequently develop atherosclerotic plaques (Loomba R & Sanyal AJ (2013) NAT REV GASTROENTEROL HEPATOL 10(11):686-90). Thus, there remains an unmet need for the development and use of therapeutics for treatment of NAFLD.

Summary of Disclosure

The current invention is based in part on the discovery of oligonucleotides (e.g., RNAi oligonucleotides) that reduce MARC1 (Mitochondrial Amidoxime Reducing Component 1) expression in the liver. Specifically, target sequences within MARC1 mRNA were identified and oligonucleotides that bind to these target sequences and inhibit MARC1 mRNA expression were generated. As demonstrated herein, the oligonucleotides inhibited human and non-human primate (NHP) MARC1 expression in the liver.

In an aspect, the invention provides an RNAi oligonucleotide for reducing MARC1 expression, the oligonucleotide comprising a sense strand and an antisense strand, wherein the sense strand and the antisense strand form a duplex region, wherein the antisense strand comprises a region of complementarity to a MARC1 mRNA target sequence of any one of SEQ ID NOs: 1-384, and wherein the region of complementarity is at least 15 contiguous nucleotides in length differing by no more than 3 nucleotides from the MARC1 mRNA target sequence.

In some embodiments of the RNAi oligonucleotide, (i) the sense strand is 15 to 50 or 18 to 36 nucleotides in length, optionally 36 nucleotides in length; optionally (ii) the antisense strand is 15 to 30 nucleotides in length, optionally 22 nucleotides in length; and optionally (iii) the duplex region is at least 19 nucleotides or at least 20 nucleotides in length.

In some embodiments of the RNAi oligonucleotide, the 3' end of the sense strand comprises a stem-loop set forth as S1-L-S2, wherein (i) S1 is complementary to S2, optionally wherein S1 and S2 are each 1-10 nucleotides in length and have the same length, optionally wherein S1 and S2 are each 1, 2, 3, 4, 5, 6, 7, 8, 9, or 10 nucleotides in length, further optionally wherein S1 and S2 are 6 nucleotides in length; and (ii) L forms a loop between S1 and S2 of 3-5 nucleotides in length, optionally wherein L is a triloop or a tetraloop, optionally wherein the tetraloop comprises the sequence 5'-GAAA-3', optionally wherein the stem-loop comprises the sequence 5'-GCAGCCGAAAGGCUGC-3' (SEQ ID NO: 1681).

In some embodiments of the RNAi oligonucleotide, the antisense strand comprises an overhang sequence of one or more nucleotides in length at the 3' terminus, optionally wherein the overhang comprises purine nucleotides, optionally wherein the overhang sequence is 2 nucleotides in length, optionally wherein the overhang is selected from AA, GG, AG, and GA, optionally wherein the overhang is GG.

In some embodiments of the RNAi oligonucleotide, at least one nucleotide of the oligonucleotide is conjugated to one or more targeting ligands, optionally wherein:
 (a) each targeting ligand comprises a carbohydrate, amino sugar, cholesterol, polypeptide or lipid; (b) the stem loop comprises one or more targeting ligands conjugated to one or more nucleotides of the stem loop; (c) the one or more targeting ligands is conjugated to one or more nucleotides of the loop, optionally wherein the loop comprises 4 nucleotides numbered 1-4 from 5' to 3', wherein nucleotides at positions 2, 3, and 4 each comprise one or more targeting ligands, wherein the targeting ligands are the same or different; (d) each targeting ligand comprises a N-acetylgalactosamine (GalNAc) moiety, optionally wherein the GalNAc moiety is a monovalent GalNAc moiety, a bivalent GalNAc moiety, a trivalent GalNAc moiety or a tetravalent GalNAc moiety; and/or (e) up to 4 nucleotides of L of the stem-loop are each conjugated to a monovalent GalNAc moiety. In some embodiments of the RNAi oligonucleotide, the targeting ligand comprises at least one GalNAc moiety and targets human liver cells (e.g., human hepatocytes).

In some embodiments of the RNAi oligonucleotide, the sense strand and antisense strands comprise nucleotide sequences selected from the group consisting of:
(a) SEQ ID NOs: 1537 and 1573, respectively;
(b) SEQ ID NOs: 1538 and 1574, respectively;
(c) SEQ ID NOs: 1539 and 1575, respectively;
(d) SEQ ID NOs: 1540 and 1576, respectively;
(e) SEQ ID NOs: 1541 and 1577, respectively;
(f) SEQ ID NOs: 1542 and 1578, respectively;

(g) SEQ ID NOs: 1543 and 1579, respectively;
(h) SEQ ID NOs: 1544 and 1580, respectively;
(i) SEQ ID NOs: 1545 and 1581, respectively;
(j) SEQ ID NOs: 1546 and 1582, respectively;
(k) SEQ ID NOs: 1547 and 1583, respectively;
(l) SEQ ID NOs: 1548 and 1584, respectively;
(m) SEQ ID NOs: 1549 and 1585, respectively;
(n) SEQ ID NOs: 1550 and 1586, respectively;
(o) SEQ ID NOs: 1551 and 1587, respectively;
(p) SEQ ID NOs: 1552 and 1588, respectively;
(q) SEQ ID NOs: 1553 and 1589, respectively;
(r) SEQ ID NOs: 1554 and 1590, respectively;
(s) SEQ ID NOs: 1555 and 1591, respectively;
(t) SEQ ID NOs: 1556 and 1592, respectively;
(u) SEQ ID NOs: 1557 and 1593, respectively;
(v) SEQ ID NOs: 1558 and 1594, respectively;
(w) SEQ ID NOs: 1559 and 1595, respectively;
(x) SEQ ID NOs: 1560 and 1596, respectively;
(y) SEQ ID NOs: 1561 and 1597, respectively;
(z) SEQ ID NOs: 1562 and 1598, respectively;
(aa) SEQ ID NOs: 1563 and 1599, respectively;
(bb) SEQ ID NOs: 1564 and 1600, respectively;
(cc) SEQ ID NOs: 1565 and 1601, respectively;
(dd) SEQ ID NOs: 1566 and 1602, respectively;
(ee) SEQ ID NOs: 1567 and 1603, respectively;
(ff) SEQ ID NOs: 1568 and 1604, respectively;
(gg) SEQ ID NOs: 1569 and 1605, respectively; and,
(hh) SEQ ID NOs: 1570 and 1606, respectively.

In some embodiments of the RNAi oligonucleotide, the sense and antisense strands comprise nucleotide sequences selected from the group consisting of:
(a) SEQ ID NOs: 1609 and 1645, respectively;
(b) SEQ ID NOs: 1610 and 1646, respectively;
(c) SEQ ID NOs: 1611 and 1647, respectively;
(d) SEQ ID NOs: 1612 and 1648, respectively;
(e) SEQ ID NOs: 1613 and 1649, respectively;
(f) SEQ ID NOs: 1614 and 1650, respectively;
(g) SEQ ID NOs: 1615 and 1651, respectively;
(h) SEQ ID NOs: 1616 and 1652, respectively;
(i) SEQ ID NOs: 1617 and 1653, respectively;
(j) SEQ ID NOs: 1618 and 1654, respectively;
(k) SEQ ID NOs: 1619 and 1655, respectively;
(l) SEQ ID NOs: 1620 and 1656, respectively;
(m) SEQ ID NOs: 1621 and 1657, respectively;
(n) SEQ ID NOs: 1622 and 1658, respectively;
(o) SEQ ID NOs: 1623 and 1659, respectively;
(p) SEQ ID NOs: 1624 and 1660, respectively;
(q) SEQ ID NOs: 1625 and 1661, respectively;
(r) SEQ ID NOs: 1626 and 1662, respectively;
(s) SEQ ID NOs: 1627 and 1663, respectively;
(t) SEQ ID NOs: 1628 and 1664, respectively;
(u) SEQ ID NOs: 1628 and 1665, respectively;
(v) SEQ ID NOs: 1630 and 1666, respectively;
(w) SEQ ID NOs: 1631 and 1667, respectively;
(x) SEQ ID NOs: 1632 and 1668, respectively;
(y) SEQ ID NOs: 1633 and 1669, respectively;
(z) SEQ ID NOs: 1634 and 1670, respectively;
(aa) SEQ ID NOs: 1635 and 1671, respectively;
(bb) SEQ ID NOs: 1636 and 1672, respectively;
(cc) SEQ ID NOs: 1637 and 1673, respectively;
(dd) SEQ ID NOs: 1638 and 1674, respectively;
(ee) SEQ ID NOs: 1639 and 1675, respectively;
(ff) SEQ ID NOs: 1640 and 1676, respectively;
(gg) SEQ ID NOs: 1641 and 1677, respectively; and,
(hh) SEQ ID NOs: 1642 and 1678, respectively.

In an embodiment a double stranded RNAi oligonucleotide (dsRNAi) for inhibiting expression of MARC1 is provided, wherein said dsRNA comprises a sense strand and an antisense strand, the antisense strand comprising a region of complementarity to a MARC1 RNA transcript, wherein the sense strand comprises the sequence and all of the modifications of 5'-mGs-mG-mC-mU-mA-mG-mA-fG-fA-fA-fG-mA-mA-mA-mG-mU-mU-mA-mA-mA-mG-mC-mA-mG-mC-mC-mG-[ademA-GalNAc]-[ademA-Gal-NAc]-[ademA-GalNAc]-mG-mG-mC-mU-mG-mC-3' (SEQ ID NO: 1615), and wherein the antisense strand comprises the sequence and all of the modifications of 5'-MePhosphonate-40-mUs-fUs-fUs-fA-fA-mC-fU-mU-mU-fC-mU-mU-mC-fU-mC-mU-mA-mG-mC-mCs-mGs-mG-3' (SEQ ID NO: 1651), wherein mC, mA, mG, and mU=2'-OMe ribonucleosides; fA, fC, fG, and fU=2'F ribonucleosides; s=phosphorothioate, and wherein ademA-GalNAc=

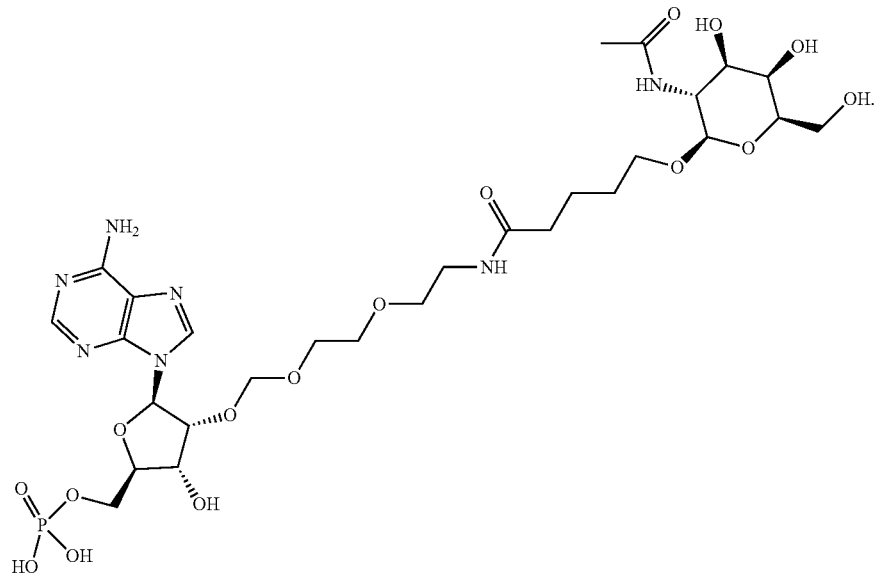 [SMILES: CC(=O)N[C@H]1[C@H](OCCCCC(=O)NCCOCCOCO[C@@H]2[C@H](O)[C@@H](COP(=O)(O)O)O[C@H]2n2cnc3c(N)ncnc32)O[C@H](CO)[C@H](O)[C@@H]1O]

In an embodiment a double stranded RNAi oligonucleotide (dsRNAi) for inhibiting expression of MARC1 is provided, wherein said dsRNA comprises a sense strand and an antisense strand, the antisense strand comprising a region of complementarity to a MARC1 RNA transcript, wherein the sense strand comprises the sequence and all of the modifications of 5'-mAs-mG-mA-mA-mC-mG-mA-fA-fA-fG-fU mU-mA-mU-mA-mU-mG-mG-mA-mA-mG-mC-mA-mG-mC-mC-mG-[ademA-GalNAc]-[ademA-GalNAc]-[ademA-GalNAc]-mG-mG-mC-mU-mG-mC-3' (SEQ ID NO: 1632), and wherein the antisense strand comprises the sequence and all of the modifications of 5'-MePhosphonate-40-mUs-fUs-fCs-fC-fA-mU-fA-mU-mA-fA-mC-mU-mU-fU-mC-mG-mU-mU-mC-mUs-mGs-mG-3' (SEQ ID NO: 1668), wherein mC, mA, mG, and mU=2'-OMe ribonucleosides; fA, fC, fG, and fU=2'F ribonucleosides; s=phosphorothioate, and wherein ademA-GalNAc=

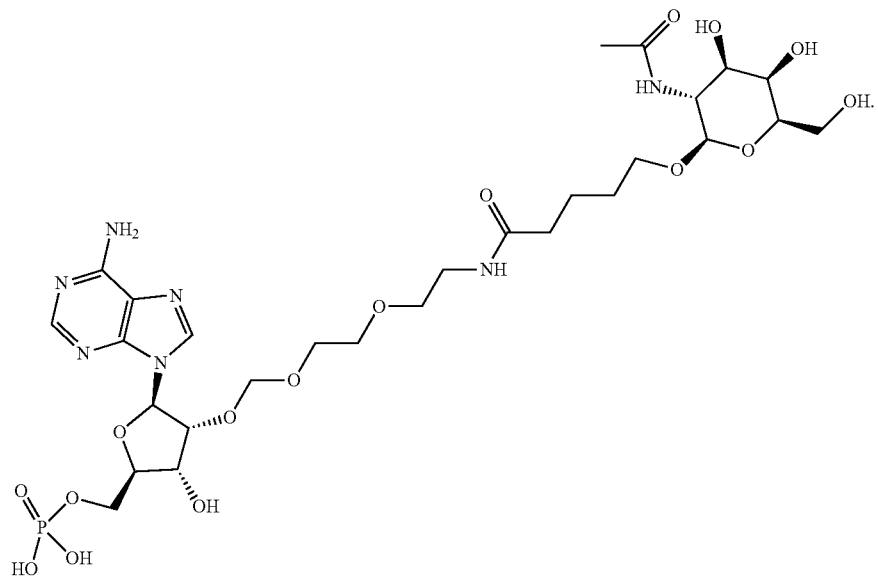 [SMILES: CC(=O)N[C@H]1[C@H](OCCCCC(=O)NCCOCCOCO[C@@H]2[C@H](O)[C@@H](COP(=O)(O)O)O[C@H]2n2cnc3c(N)ncnc32)O[C@H](CO)[C@H](O)[C@@H]1O]

In an embodiment a double stranded RNAi oligonucleotide (dsRNAi) for inhibiting expression of MARC1 is provided, wherein said dsRNA comprises a sense strand and an antisense strand, the antisense strand comprising a region of complementarity to a MARC1 RNA transcript, wherein the sense strand comprises the sequence and all of the modifications of 5'-mAs-mA-mG-mU-mU-mG mA-fC-fU-fA-fA-mA-mC-mU-mU-mG-mA-mA-mA-mA-mG-mC-mA-mG-mC-mC-mG-[ademA-GalNAc]-[ademA-GalNAc]-[ademA-GalNAc]-mG-mG-mC-mU-mG-mC-3' (SEQ ID NO: 1640), and wherein the antisense strand comprises the sequence and all of the modifications of 5'-MePhosphonate-40-mUs-fUs-fUs-fU-fC-mA-fA-mG-mU-fU-mU-mA-mG-fU-mC-mA-mA-mC-mU-mUs-mGs-mG-3' (SEQ ID NO: 1676), wherein mC, mA, mG, and mU=2'-OMe ribonucleosides; fA, fC, fG, and fU=2'F ribonucleosides; s=phosphorothioate, and wherein ademA-GalNAc=

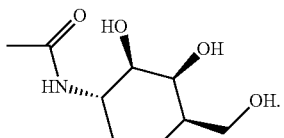
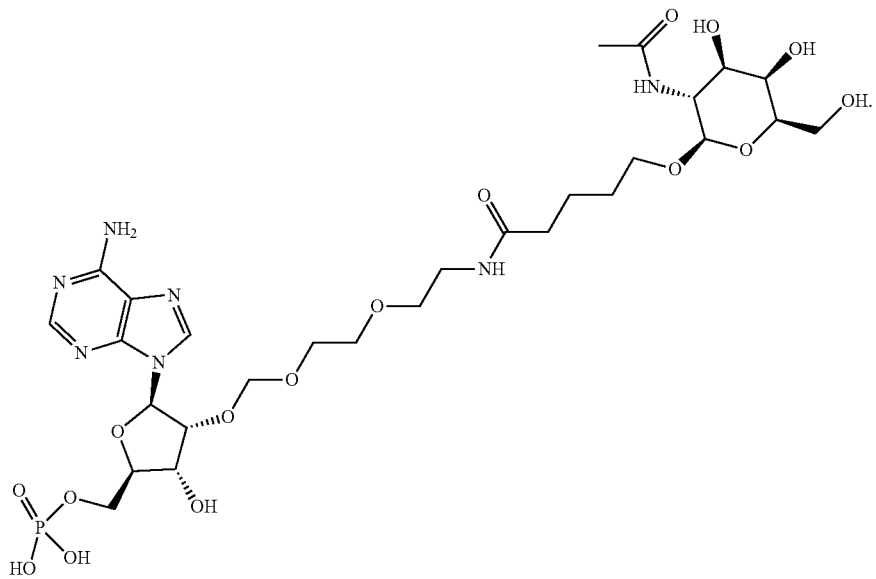 [SMILES: CC(=O)N[C@H]1[C@H](OCCCCC(=O)NCCOCCOCO[C@@H]2[C@H](O)[C@@H](COP(=O)(O)O)O[C@H]2n2cnc3c(N)ncnc32)O[C@H](CO)[C@H](O)[C@@H]1O]

In an embodiment a double stranded RNAi oligonucleotide (dsRNAi) for inhibiting expression of MARC1 is provided, wherein said dsRNA comprises a sense strand and an antisense strand, the antisense strand comprising a region of complementarity to a MARC1 RNA transcript, wherein the sense strand comprises the sequence and all of the modifications of 5'-mUs-mG-mU-mG-mA-mA mU-fA-fA-fA-fU-mG-mG-mA-mA-mG-mC-mU-mA-mA-mG-mC-mA-mG-mC-mC-mG-[ademA-GalNAc]-[ademA-GalNAc]-[ademA-GalNAc]-mG-mG-mC-mU-mG-mC-3' (SEQ ID NO: 1625), and wherein the antisense strand comprises the sequence and all of the modifications of 5'-MePhosphonate-40-mUs-fUs-fAs-fG-fC-mU-fU-mC-mC-fA-mU-mU-mU-fA-mU-mU-mC-mA-mC-mAs-mGs-mG-3' (SEQ ID NO: 1661), wherein mC, mA, mG, and mU=2'-OMe ribonucleosides; fA, fC, fG, and fU=2'F ribonucleosides; s=phosphorothioate, and wherein ademA-GalNAc=

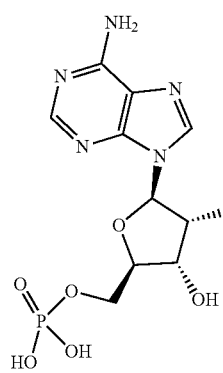
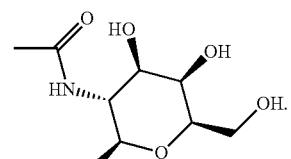

Without being bound by theory, the oligonucleotides described herein are useful for treating a disease, disorder or condition where the MARC1 enzyme plays a causal role.

In an aspect, the invention provides a pharmaceutical composition comprising the RNAi oligonucleotide described herein and a pharmaceutically acceptable carrier, delivery agent or excipient.

In an aspect, the invention provides a kit comprising the RNAi described herein, an optional pharmaceutically acceptable carrier, and a package insert comprising instructions for administration to a subject having a disease, disorder or condition associated with MARC1 expression, optionally for the treatment of NAFLD, NASH, or alcoholic steatohepatitis (ASH).

In an aspect, the invention provides a use of the RNAi oligonucleotide described herein, in the manufacture of a medicament for the treatment of a disease, disorder or condition associated with MARC1 expression, optionally for the treatment of a disease or condition associated with MARC1 expression in hepatocytes, optionally for the treatment of NAFLD, NASH, or ASH. optionally for use in combination with a second composition or therapeutic agent.

DETAILED DESCRIPTION

Figure 1:
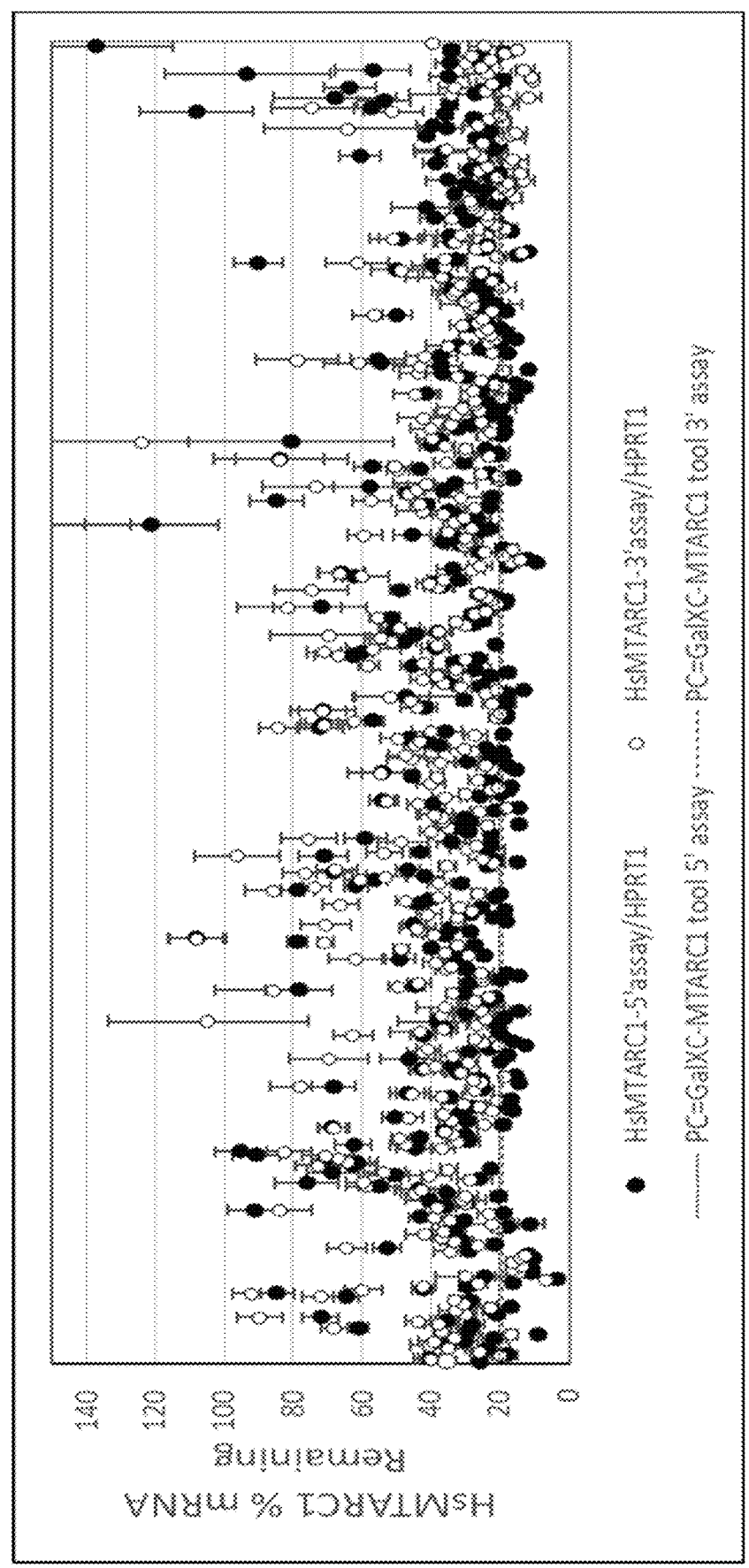
FIG. 1 provides a graph depicting the percent (%) of human MARC1 mRNA remaining in Huh7 cells endogenously expressing human MARC1, also referred to as MTARC1, after 24-hours treatment with 1 nM of DsiRNA targeting various regions of the MARC1 gene. 384 DsiRNAs were designed and screened. Two primer pairs were used to measure MARC1 (SEQ ID NOs: 1684-1687), and expression was normalized between samples using the HPRT housekeeping gene (SEQ ID NOs: 1688 and 1689).

MARC1 (Mitochondrial Amidoxime Reducing Component 1, Molybdenum Cofactor Sulfurase C-terminal Domain-Containing Protein 1, Moco Sulfurase C-Terminal Domain Containing Protein 1, MOSC1, MOSC Domain-Containing Protein 1, MTARC1) is a protein which catalyzes the reduction of N-oxygenated molecules in various metabolic processes. While the biological function and mechanisms of MARC1 have yet to be elucidated, a common missense variant has been identified in MARC1 that protects subjects against cirrhosis. Carriers of this variant also have lower blood cholesterol levels and reduced liver fat, indicating MARC1 may be an effective therapeutic target for NAFLD, NASH and ASH. It should be understood that the genetic polymorphisms in MARC1 impact expression and/or functionality of MARC1 across all bodily tissues from birth, with MARC1 being expressed widely and at various levels in different organs. As described herein, oligonucleotides targeting MARC1 specifically in hepatocytes not only inhibit MARC1 expression in vitro and in vivo, but also provide a therapeutic effect in a mouse model of NASH. Specifically, reduction of MARC1 expression reduced the number of hepatocytes with liver droplets and the steatosis fraction. Additionally, MARC1 inhibition reduced several regulators of hepatic fibrosis in the NASH model. These various improved disease outcomes demonstrate the therapeutic efficacy of MARC1 inhibition, specifically in hepatocytes.

Taken together, and without being bound by theory, antagonism/inhibition of MARC1, specifically in hepatocytes (e.g., via MARC1-targeted RNAi oligonucleotides), may decrease the risk and severity of NAFLD, NASH, and alcoholic steatohepatitis (ASH). This approach may be best managed by a specific and targeted reduction of the MARC1 expression in the liver while other organs, tissues or cells expressing MARC1 are left essentially unaffected. In this sense the current invention may provide an improved modality of treatment given its specific targeting of mRNA production in the liver.

According to some aspects, the current invention provides oligonucleotides (e.g., RNAi oligonucleotides) that reduce MARC1 expression in the liver. In some embodiments, the oligonucleotides provided herein are designed to treat diseases associated with MARC1 expression in the liver. In some respects, the current invention provides methods of treating a disease associated with overall MARC1 expression by reducing MARC1 expression in specific cells (e.g., hepatocytes) or organs (e.g., liver).

Oligonucleotide Inhibitors of MARC1 Expression
MARC1 Target Sequences

In some embodiments, an oligonucleotide herein (e.g., an RNAi oligonucleotide) is targeted to a target sequence comprising a MARC1 mRNA. In some embodiments, an oligonucleotide described herein is targeted to a target sequence within a MARC1 mRNA sequence. In some embodiments, the oligonucleotide described herein corresponds to a target sequence within a MARC1 mRNA sequence. In some embodiments, the oligonucleotide, or a portion, fragment, or strand thereof (e.g., an antisense strand or a guide strand of a double-stranded (ds) RNAi oligonucleotide) binds or anneals to a target sequence comprising MARC1 mRNA, thereby inhibiting MARC1 expression.

In some embodiments, the oligonucleotide is targeted to a MARC1 target sequence for the purpose of inhibiting MARC1 expression in vivo. In some embodiments, the amount or extent of inhibition of MARC1 expression by an oligonucleotide targeted to a MARC1 target sequence correlates with the potency of the oligonucleotide. In some embodiments, the amount or extent of inhibition of MARC1 expression by an oligonucleotide targeted to a MARC1 target sequence correlates with the amount or extent of therapeutic benefit in a subject or patient having a disease, disorder or condition associated with MARC1 expression treated with the oligonucleotide.

Through examination of the nucleotide sequence of mRNAs encoding MARC1, including mRNAs of multiple different species (e.g., human, cynomolgus monkey, and mouse; see, e.g., Example 2) and as a result of in vitro and in vivo testing (see, e.g., Examples 2-5), it has been discovered that certain nucleotide sequences of MARC1 mRNA are more amenable than others to oligonucleotide-based inhibition and are thus useful as target sequences for the oligonucleotides herein. In some embodiments, a sense strand of an oligonucleotide (e.g., an RNAi oligonucleotide) described herein comprises a MARC1 target sequence. In some embodiments, a portion or region of the sense strand of an oligonucleotide described herein (e.g., an RNAi oligonucleotide) comprises a MARC1 target sequence. In some embodiments, a MARC1 target sequence comprises, or consists of, a sequence of any one of SEQ ID NOs:1-384. In some embodiments, a MARC1 target sequence comprises, or consists of, the sequence set forth in SEQ ID NO: 234, 298, 356, or 376.

MARC1 Targeting Sequences

In some embodiments, the oligonucleotides herein (e.g., RNAi oligonucleotides) have regions of complementarity to MARC1 mRNA (e.g., within a target sequence of MARC1 mRNA) for purposes of targeting the MARC1 mRNA in cells and inhibiting and/or reducing MARC1 expression. In some embodiments, the oligonucleotides herein comprise a MARC1 targeting sequence (e.g., an antisense strand or a guide strand of a dsRNAi oligonucleotide) having a region of complementarity that binds or anneals to a MARC1 target sequence by complementary (Watson-Crick) base pairing. The targeting sequence or region of complementarity is generally of a suitable length and base content to enable binding or annealing of the oligonucleotide (or a strand thereof) to a MARC1 mRNA for purposes of inhibiting and/or reducing MARC1 expression. In some embodiments, the targeting sequence or region of complementarity is at least about 12, at least about 13, at least about 14, at least about 15, at least about 16, at least about 17, at least about 18, at least about 19, at least about 20, at least about 21, at least about 22, at least about 23, at least about 24, at least about 25, at least about 26, at least about 27, at least about 28, at least about 29, or at least about 30 nucleotides in length. In some embodiments, the targeting sequence or region of complementarity is about 12 to about 30 (e.g., 12 to 30, 12 to 22, 15 to 25, 17 to 21, 18 to 27, 19 to 27, or 15 to 30) nucleotides in length. In some embodiments, the targeting sequence or region of complementarity is about 12, 13, 14, 15, 16, 17, 18, 19, 20, 21, 22, 23, 24, 25, 26, 27, 28, 29, or 30 nucleotides in length. In some embodiments, the targeting sequence or region of complementarity is 18 nucleotides in length. In some embodiments, the targeting sequence or region of complementarity is 19 nucleotides in length. In some embodiments, the targeting sequence or region of complementarity is 20 nucleotides in length. In some embodiments, the targeting sequence or region of complementarity is 21 nucleotides in length. In some embodiments, the targeting sequence or region of complementarity is 22 nucleotides in length. In some embodiments, the targeting sequence or region of complementarity is 23 nucleotides in length. In some embodiments, the targeting sequence or region of complementarity is 24 nucleotides in length. In some embodiments, an oligonucleotide comprises a target sequence or region of complementarity complementary to a sequence of any one of SEQ ID NOs: 1-384, and the targeting sequence or region of complementarity is 18 nucleotides in length. In some embodiments, an oligonucleotide comprises a target sequence or region of complementarity complementary to a sequence of any one of SEQ ID NOs: 1-384, and the targeting sequence or region of complementarity is 19 nucleotides in length. In some embodiments, an oligonucleotide comprises a target sequence or region of complementarity complementary to a sequence of any one of SEQ ID NOs: 769-1152, and the targeting sequence or region of complementarity is 20 nucleotides in length. In some embodiments, an oligonucleotide comprises a target sequence or region of complementarity complementary to a sequence of any one of SEQ ID NOs: 769-1152, and the targeting sequence or region of complementarity is 21 nucleotides in length. In some embodiments, an oligonucleotide comprises a target sequence or region of complementarity complementary to a sequence of any one of SEQ ID NOs: 769-1152, and the targeting sequence or region of complementarity is 22 nucleotides in length. In some embodiments, an oligonucleotide comprises a target sequence or region of complementarity complementary to a sequence of any one of SEQ ID NOs: 769-1152, and the targeting sequence or region of complementarity is 23 nucleotides in length. In some embodiments, an oligonucleotide comprises a target sequence or region of complementarity complementary to a sequence of any one of SEQ ID NOs: 769-1152 and the targeting sequence or region of complementarity is 24 nucleotides in length.

In some embodiments, an oligonucleotide herein (e.g., an RNAi oligonucleotide) comprises a targeting sequence or a region of complementarity (e.g., an antisense strand or a guide strand of a double-stranded oligonucleotide) that is fully complementary to a MARC1 target sequence. In some embodiments, the targeting sequence or region of complementarity is partially complementary to a MARC1 target sequence. In some embodiments, the oligonucleotide comprises a targeting sequence or region of complementarity that is fully complementary to a MARC1 target sequence. In some embodiments, the oligonucleotide comprises a targeting sequence or region of complementarity that is partially complementary to a MARC1 target sequence.

In some embodiments, the oligonucleotide comprises a targeting sequence or region of complementarity that is fully complementary to a sequence of any one of SEQ ID NOs: 1-384. In some embodiments, the oligonucleotide comprises a targeting sequence or region of complementarity that is fully complementary to the sequence set forth in SEQ ID NOs: 234, 298, 356, or 376. In some embodiments, the oligonucleotide comprises a targeting sequence or region of complementarity that is partially complementary to a sequence of any one of SEQ ID NOs: 1-384. In some embodiments, the oligonucleotide comprises a targeting sequence or region of complementarity that is partially complementary to the sequence set forth in SEQ ID NOs: 234, 298, 356, or 376.

In some embodiments, an oligonucleotide herein (e.g., an RNAi oligonucleotide) comprises a targeting sequence or region of complementarity that is complementary to a contiguous sequence of nucleotides within a MARC1 mRNA, wherein the contiguous sequence of nucleotides is about 12 to about 30 nucleotides in length (e.g., 12 to 30, 12 to 28, 12 to 26, 12 to 24, 12 to 20, 12 to 18, 12 to 16, 14 to 22, 16 to 20, 18 to 20, or 18 to 19 nucleotides in length). In some embodiments, the oligonucleotide comprises a targeting sequence or region of complementarity that is complementary to a contiguous sequence of nucleotides within a MARC1 mRNA, wherein the contiguous sequence of nucleotides is 10, 11, 12, 13, 14, 15, 16, 17, 18, 19, or 20 nucleotides in length. In some embodiments, the oligonucleotide comprises a targeting sequence or region of complementarity that is complementary to a contiguous sequence of nucleotides within a MARC1 mRNA, wherein the contiguous sequence of nucleotides is 19 nucleotides in length. In some embodiments, the oligonucleotide comprises a targeting sequence or region of complementarity that is complementary to a contiguous sequence of nucleotides within a MARC1 mRNA, wherein the contiguous sequence of nucleotides is 20 nucleotides in length.

In some embodiments, an oligonucleotide herein (e.g., an RNAi oligonucleotide) comprises a targeting sequence or a region of complementary that is complementary to a contiguous sequence of nucleotides of any one of SEQ ID NOs: 1-384, optionally wherein the contiguous sequence of nucleotides is 19 nucleotides in length. In some embodiments, the oligonucleotide comprises a targeting sequence or a region of complementary that is complementary to a contiguous sequence of nucleotides of any one of SEQ ID NOs: 234, 298, 356, or 376, wherein the contiguous sequence of nucleotides is 19 nucleotides in length. In some embodiments, the oligonucleotide comprises a targeting sequence or a region of complementary that is complementary to a contiguous sequence of nucleotides of any one of SEQ ID NOs: 769-1152, wherein the contiguous sequence of nucleotides is 20 nucleotides in length. In some embodiments, the oligonucleotide comprises a targeting sequence or a region of complementary that is complementary to a contiguous sequence of nucleotides of any one of SEQ ID NOs: 1002, 1066, 1124, and 1144, wherein the contiguous sequence of nucleotides is 20 nucleotides in length.

In some embodiments, a targeting sequence or region of complementarity of an oligonucleotide herein (e.g., an RNAi oligonucleotide) is complementary to a contiguous sequence of nucleotides of any one of SEQ ID NOs: 1-384 and spans the entire length of an antisense strand. In some embodiments, a targeting sequence or region of complementarity of the oligonucleotide is complementary to a contiguous sequence of nucleotides of SEQ ID NOs: 1-384 and spans a portion of the entire length of an antisense strand. In some embodiments, an oligonucleotide herein (e.g., an RNAi oligonucleotide) comprises a region of complementarity (e.g., on an antisense strand of a dsRNA) that is at least partially (e.g., fully) complementary to a contiguous stretch of nucleotides spanning nucleotides 1-19 or 1-20 of a sequence as set forth in any one of SEQ ID NOs: 769-1152.

In some embodiments, an oligonucleotide herein (e.g., an RNAi oligonucleotide) comprises a targeting sequence or region of complementarity having one or more base pair (bp) mismatches with the corresponding MARC1 target sequence. In some embodiments, the targeting sequence or region of complementarity may have up to about 1, up to about 2, up to about 3, up to about 4, up to about 5, etc. mismatches with the corresponding MARC1 target sequence provided that the ability of the targeting sequence or region of complementarity to bind or anneal to the MARC1 mRNA under appropriate hybridization conditions and/or the ability of the oligonucleotide to inhibit MARC1 expression is maintained. Alternatively, the targeting sequence or region of complementarity may have no more than 1, no more than 2, no more than 3, no more than 4, or no more than 5 mismatches with the corresponding MARC1 target sequence provided that the ability of the targeting sequence or region of complementarity to bind or anneal to the MARC1 mRNA under appropriate hybridization conditions and/or the ability of the oligonucleotide to inhibit MARC1 expression is maintained. In some embodiments, the oligonucleotide comprises a targeting sequence or region of complementarity having 1 mismatch with the corresponding target sequence. In some embodiments, the oligonucleotide comprises a targeting sequence or region of complementarity having 2 mismatches with the corresponding target sequence. In some embodiments, the oligonucleotide comprises a targeting sequence or region of complementarity having 3 mismatches with the corresponding target sequence. In some embodiments, the oligonucleotide comprises a targeting sequence or region of complementarity having 4 mismatches with the corresponding target sequence. In some embodiments, the oligonucleotide comprises a targeting sequence or region of complementarity having 5 mismatches with the corresponding target sequence. In some embodiments, the oligonucleotide comprises a targeting sequence or region of complementarity having more than one mismatch (e.g., 2, 3, 4, 5, or more mismatches) with the corresponding target sequence, wherein at least 2 (e.g., all) of the mismatches are positioned consecutively (e.g., 2, 3, 4, 5, or more mismatches in a row), or wherein the mismatches are interspersed throughout the targeting sequence or region of complementarity. In some embodiments, the oligonucleotide comprises a targeting sequence or region of complementarity having more than one mismatch (e.g., 2, 3, 4, 5, or more mismatches) with the corresponding target sequence, wherein at least 2 (e.g., all) of the mismatches are positioned consecutively (e.g., 2, 3, 4, 5, or more mismatches in a row), or wherein at least one or more non-mismatched base pair is located between the mismatches, or a combination thereof. In some embodiments, the oligonucleotide comprises a targeting sequence or a region of complementary that is complementary to a contiguous sequence of nucleotides of any one of SEQ ID NOs: 1-384, wherein the targeting sequence or region of complementarity may have up to about 1, up to about 2, up to about 3, up to about 4, up to about 5, etc. mismatches with the corresponding MARC1 target sequence. In some embodiments, the oligonucleotide comprises a targeting sequence or a region of complementary that is complementary to a contiguous sequence of nucleotides of any one of SEQ ID NOs: 1-384, wherein the targeting sequence or region of complementarity may have no more than 1, no more than 2, no more than 3, no more than 4, or no more than 5 mismatches with the corresponding MARC1 target sequence. In some embodiments, the oligonucleotide comprises a targeting sequence or a region of complementary that is complementary to a contiguous sequence of nucleotides of any one of SEQ ID NOs: 234, 298, 356, or 376, wherein the targeting sequence or region of complementarity may have up to about 1, up to about 2, up to about 3, up to about 4, up to about 5, etc. mismatches with the corresponding MARC1 target sequence. In some embodiments, the oligonucleotide comprises a targeting sequence or a region of complementary that is complementary to a contiguous sequence of nucleotides of any one of SEQ ID NOs: 234, 298, 356, or 376, wherein the targeting sequence or region of complementarity may have no more than 1, no more than 2, no more than 3, no more than 4, or no more than 5 mismatches with the corresponding MARC1 target sequence.

Types of Oligonucleotides

A variety of oligonucleotide types and/or structures are useful for targeting MARC1 in the methods herein including, but not limited to, RNAi oligonucleotides, antisense oligonucleotides (ASOs), miRNAs, etc. Any of the oligonucleotide types described herein or elsewhere are contemplated for use as a framework to incorporate a MARC1 targeting sequence herein for the purposes of inhibiting MARC1 expression.

In some embodiments, the oligonucleotides herein inhibit MARC1 expression by engaging with RNA interference (RNAi) pathways upstream or downstream of Dicer involvement. For example, RNAi oligonucleotides have been developed with each strand having sizes of about 19-25 nucleotides with at least one 3'-overhang of 1 to 5 nucleotides (see, e.g., U.S. Pat. No. 8,372,968). Longer oligonucleotides also have been developed that are processed by Dicer to generate active RNAi products (see, e.g., U.S. Pat. No. 8,883,996). Further work produced extended dsRNAs where at least one end of at least one strand is extended beyond a duplex targeting region, including structures where one of the strands includes a thermodynamically stabilizing tetraloop structure (see, e.g., U.S. Pat. Nos. 8,513,207 and 8,927,705, as well as Intl. Patent Application Publication No. WO 2010/033225). Such structures may include single-stranded (ss) extensions (on one or both sides of the molecule) as well as double-stranded (ds) extensions.

In some embodiments, the oligonucleotides herein engage with the RNAi pathway downstream of the involvement of Dicer (e.g., Dicer cleavage). In some embodiments, the oligonucleotides described herein are Dicer substrates. In some embodiments, upon endogenous Dicer processing, double-stranded nucleic acids of 19-23 nucleotides in length capable of reducing MARC1 expression are produced. In some embodiments, the oligonucleotide has an overhang (e.g., of 1, 2, or 3 nucleotides in length) in the 3' end of the antisense strand. In some embodiments, the oligonucleotide (e.g., siRNA) comprises a 21-nucleotide guide strand that is antisense to a target RNA and a complementary passenger strand, in which both strands anneal to form a 19-bp duplex and 2 nucleotide overhangs at either or both 3' ends. Longer oligonucleotide designs also are available including oligonucleotides having a guide strand of 23 nucleotides and a passenger strand of 21 nucleotides, where there is a blunt end on the right side of the molecule (3' end of passenger strand/5' end of guide strand) and a two nucleotide 3'-guide strand overhang on the left side of the molecule (5' end of the passenger strand/3' end of the guide strand). In such molecules, there is a 21 bp duplex region. See, e.g., U.S. Pat. Nos. 9,012,138; 9,012,621; and 9,193,753.

In some embodiments, the oligonucleotides herein comprise sense and antisense strands that are both in the range of about 17 to 36 (e.g., 17 to 36, 20 to 25, or 21-23) nucleotides in length. In some embodiments, the oligonucleotides described herein comprise an antisense strand of 19-30 nucleotides in length and a sense strand of 19-50 nucleotides in length, wherein the antisense and sense strands are separate strands which form an asymmetric duplex region having an overhang of 1-4 nucleotides at the 3' terminus of the antisense strand. In some embodiments, an oligonucleotide herein comprises a sense and antisense strand that are both in the range of about 19-22 nucleotides in length. In some embodiments, the sense and antisense strands are of equal length. In some embodiments, an oligonucleotide comprises sense and antisense strands, such that there is a 3'-overhang on either the sense strand or the antisense strand, or both the sense and antisense strand. In some embodiments, for oligonucleotides that have sense and antisense strands that are both in the range of about 21-23 nucleotides in length, a 3'-overhang on the sense, antisense, or both sense and antisense strands is 1 or 2 nucleotides in length. In some embodiments, the oligonucleotide has a guide strand of 22 nucleotides and a passenger strand of 20 nucleotides, where there is a blunt end on the right side of the molecule (3' end of passenger strand/5' end of guide strand) and a 2 nucleotide 3'-guide strand overhang on the left side of the molecule (5' end of the passenger strand/3' end of the guide strand). In such molecules, there is a 20 bp duplex region.

Other oligonucleotide designs for use with the compositions and methods herein include: 16-mer siRNAs (see, e.g., NUCLEIC ACIDS IN CHEMISTRY AND BIOLOGY, Blackburn (ed.), ROYAL SOCIETY OF CHEMISTRY, 2006), shRNAs (e.g., having 19 bp or shorter stems; see, e.g., Moore et al. (2010) METHODS MOL. BIOL. 629:141-158), blunt siRNAs (e.g., of 19 bps in length; see, e.g., Kraynack & Baker (2006) RNA 12:163-176), asymmetrical siRNAs (aiRNA; see, e.g., Sun et al. (2008) NAT. BIOTECHNOL. 26:1379-82), asymmetric shorter-duplex siRNA (see, e.g., Chang et al. (2009) MOL. THER. 17:725-32), fork siRNAs (see, e.g., Hohjoh (2004) FEBS LETT. 557:193-98), ss siRNAs (Elsner (2012) NAT. BIOTECHNOL. 30:1063), dumbbell-shaped circular siRNAs (see, e.g., Abe et al. (2007) J. AM. CHEM. SOC. 129:15108-09), and small internally segmented interfering RNA (siRNA; see, e.g., Bramsen et al. (2007) NUCLEIC ACIDS RES. 35:5886-97). Further non-limiting examples of an oligonucleotide structures that may be used in some embodiments to reduce or inhibit the expression of MARC1 are microRNA (miRNA), short hairpin RNA (shRNA) and short siRNA (see, e.g., Hamilton et al. (2002) EMBO J. 21:4671-79; see also, US Patent Application Publication No. 2009/0099115).

Still, in some embodiments, an oligonucleotide for reducing or inhibiting MARC1 expression herein is single-stranded (ss). Such structures may include but are not limited to single-stranded RNAi molecules. Recent efforts have demonstrated the activity of ss RNAi molecules (see, e.g., Matsui et al. (2016) MOL. THER. 24:946-55). However, in some embodiments, oligonucleotides herein are antisense oligonucleotides (ASOs). An antisense oligonucleotide is a single-stranded oligonucleotide that has a nucleobase sequence which, when written in the 5' to 3' direction, comprises the reverse complement of a targeted segment of a particular nucleic acid and is suitably modified (e.g., as a gapmer) to induce RNaseH-mediated cleavage of its target RNA in cells or (e.g., as a mixmer) so as to inhibit translation of the target mRNA in cells. ASOs for use herein may be modified in any suitable manner known in the art including, for example, as shown in U.S. Pat. No. 9,567,587 (including, e.g., length, sugar moieties of the nucleobase (pyrimidine, purine), and alterations of the heterocyclic portion of the nucleobase). Further, ASOs have been used for decades to reduce expression of specific target genes (see, e.g., Bennett et al. (2017) ANNU. REV. PHARMACOL. 57:81-105).

In some embodiments, the antisense oligonucleotide shares a region of complementarity with MARC1 mRNA. In some embodiments, the antisense oligonucleotide targets various areas of the human MARC1 gene identified as NM_001251935.1. In some embodiments, the antisense oligonucleotide is 15-50 nucleotides in length. In some embodiments, the antisense oligonucleotide is 15-25 nucleotides in length. In some embodiments, the antisense oligonucleotide is 22 nucleotides in length. In some embodiments, the antisense oligonucleotide is complementary to any one of SEQ ID NOs: 1-384. In some embodiments, the antisense oligonucleotide is at least 15 contiguous nucleotides in length. In some embodiments, the antisense oligonucleotide is at least 19 contiguous nucleotides in length. In some embodiments, the antisense oligonucleotide is at least 20 contiguous nucleotides in length. In some embodiments, the antisense oligonucleotide differs by 1, 2, or 3 nucleotides from the target sequence.

Double-Stranded Oligonucleotides

In some aspects, the current invention provides double-stranded (ds) RNAi oligonucleotides for targeting MARC1 mRNA and inhibiting MARC1 expression (e.g., via the RNAi pathway) comprising a sense strand (also referred to herein as a passenger strand) and an antisense strand (also referred to herein as a guide strand). In some embodiments, the sense strand and antisense strand are separate strands and are not covalently linked. In some embodiments, the sense strand and antisense strand are covalently linked. In some embodiments, the sense strand and antisense strand form a duplex region, wherein the sense strand and antisense strand, or a portion thereof, binds with one another in a complementary fashion (e.g., by Watson-Crick base pairing).

In some embodiments, the sense strand has a first region (R1) and a second region (R2), wherein R2 comprises a first subregion (S1), a tetraloop or triloop (L), and a second subregion (S2), wherein L is located between S1 and S2, and wherein S1 and S2 form a second duplex (D2). D2 may have various length. In some embodiments, D2 is about 1-6 bp in length. In some embodiments, D2 is 2-6, 3-6, 4-6, 5-6, 1-5, 2-5, 3-5, or 4-5 bp in length. In some embodiments, D2 is 1, 2, 3, 4, 5, or 6 bp in length. In some embodiments, D2 is 6 bp in length. In some embodiments, R1 of the sense strand and the antisense strand form a first duplex (D1). In some embodiments, D1 is at least about 15 (e.g., at least 15, at least 16, at least 17, at least 18, at least 19, at least 20, or at least 21) nucleotides in length. In some embodiments, D1 is in the range of about 12 to 30 nucleotides in length (e.g., 12 to 30, 12 to 27, 15 to 22, 18 to 22, 18 to 25, 18 to 27, 18 to 30, or 21 to 30 nucleotides in length). In some embodiments, D1 is at least 12 nucleotides in length (e.g., at least 12, at least 15, at least 20, at least 25, or at least 30 nucleotides in length). In some embodiments, D1 is 12, 13, 14, 15, 16, 17, 18, 19, 20, 21, 22, 23, 24, 25, 26, 27, 28, 29, or 30 nucleotides in length. In some embodiments, D1 is 20 nucleotides in length. In some embodiments, D1 comprising sense strand and antisense strand does not span the entire length of the sense strand and/or antisense strand. In some embodiments, D1 comprising the sense strand and antisense strand spans the entire length of either the sense strand or antisense strand or both. In certain embodiments, D1 comprising the sense strand and antisense strand spans the entire length of both the sense strand and the antisense strand.

In some embodiments, an oligonucleotide provided herein comprises a sense strand having a sequence of any one of SEQ ID NOs: 769-1152 and an antisense strand comprising a complementary sequence selected from SEQ ID NOs: 1153-1536. In some embodiments, an oligonucleotide provided herein comprises a sense strand having a sequence of any one of SEQ ID NOs: 1-384 and an antisense strand comprising a complementary sequence selected from SEQ ID NOs: 385-768.

In some embodiments, an oligonucleotide provided herein (e.g., an RNAi oligonucleotide) comprises a sense strand having a sequence of any one of SEQ ID NOs: 1537-1570 and an antisense strand comprising a complementary sequence selected from SEQ ID NOs: 1573-1606 as is arranged in Tables 4 and 6.

In some embodiments, an oligonucleotide provided herein (e.g., an RNAi oligonucleotide) comprises a sense strand and an antisense strand comprising nucleotide sequences selected from:

(a) SEQ ID NOs: 1537 and 1573, respectively;
(b) SEQ ID NOs: 1538 and 1574, respectively;
(c) SEQ ID NOs: 1539 and 1575, respectively;
(d) SEQ ID NOs: 1540 and 1576, respectively;
(e) SEQ ID NOs: 1541 and 1577, respectively;
(f) SEQ ID NOs: 1542 and 1578, respectively;
(g) SEQ ID NOs: 1543 and 1579, respectively;
(h) SEQ ID NOs: 1544 and 1580, respectively;
(i) SEQ ID NOs: 1545 and 1581, respectively;
(j) SEQ ID NOs: 1546 and 1582, respectively;
(k) SEQ ID NOs: 1547 and 1583, respectively;
(l) SEQ ID NOs: 1548 and 1584, respectively;
(m) SEQ ID NOs: 1549 and 1585, respectively;
(n) SEQ ID NOs: 1550 and 1586, respectively;
(o) SEQ ID NOs: 1551 and 1587, respectively;
(p) SEQ ID NOs: 1552 and 1588, respectively;

(q) SEQ ID NOs: 1553 and 1589, respectively;
(r) SEQ ID NOs: 1554 and 1590, respectively;
(s) SEQ ID NOs: 1555 and 1591, respectively;
(t) SEQ ID NOs: 1556 and 1592, respectively;
(u) SEQ ID NOs: 1557 and 1593, respectively;
(v) SEQ ID NOs: 1558 and 1594, respectively;
(w) SEQ ID NOs: 1559 and 1595, respectively;
(x) SEQ ID NOs: 1560 and 1596, respectively;
(y) SEQ ID NOs: 1561 and 1597, respectively;
(z) SEQ ID NOs: 1562 and 1598, respectively;
(aa) SEQ ID NOs: 1563 and 1599, respectively;
(bb) SEQ ID NOs: 1564 and 1600, respectively;
(cc) SEQ ID NOs: 1565 and 1601, respectively;
(dd) SEQ ID NOs: 1566 and 1602, respectively;
(ee) SEQ ID NOs: 1567 and 1603, respectively;
(ff) SEQ ID NOs: 1568 and 1604, respectively;
(gg) SEQ ID NOs: 1569 and 1605, respectively; and,
(hh) SEQ ID NOs: 1570 and 1606, respectively.

In some embodiments, an oligonucleotide provided herein (e.g., an RNAi oligonucleotide) comprises a sense strand and an antisense strand comprising nucleotide sequences selected from:
(a) SEQ ID NOs: 1543 and 1579, respectively;
(b) SEQ ID NOs: 1560 and 1596, respectively;
(c) SEQ ID NOs: 1568 and 1604, respectively; and,
(d) SEQ ID NOs: 1553 and 1589, respectively.

In some embodiments, the sense strand comprises the sequence of SEQ ID NO: 1543 and the antisense strand comprises the sequence of SEQ ID NO: 1579.

In some embodiments, the sense strand comprises the sequence of SEQ ID NO: 1560 and the antisense strand comprises the sequence of SEQ ID NO: 1596.

In some embodiments, the sense strand comprises the sequence of SEQ ID NO: 1568 and the antisense strand comprises the sequence of SEQ ID NO: 1604.

In some embodiments, the sense strand comprises the sequence of SEQ ID NO: 1553 and the antisense strand comprises the sequence of SEQ ID NO: 1589.

It should be appreciated that, in some embodiments, sequences presented in the Sequence Listing may be referred to in describing the structure of an oligonucleotide (e.g., a dsRNAi oligonucleotide) or other nucleic acid. In such embodiments, the actual oligonucleotide or other nucleic acid may have one or more alternative nucleotides (e.g., an RNA counterpart of a DNA nucleotide or a DNA counterpart of an RNA nucleotide) and/or one or more modified nucleotides and/or one or more modified internucleotide linkages and/or one or more other modification when compared with the specified sequence while retaining essentially same or similar complementary properties as the specified sequence.

In some embodiments, an oligonucleotide herein (e.g., an RNAi oligonucleotide) comprises a 25-nucleotide sense strand and a 27-nucleotide antisense strand that when acted upon by a Dicer enzyme results in an antisense strand that is incorporated into the mature RISC. In some embodiments, the 25-nucleotide sense strand comprises a sequence selected from SEQ ID NOs: 769-1152. In some embodiments, the 27-nucleotide antisense strand comprises a sequence selected from SEQ ID NOs: 1153-1536. In some embodiments, the sense strand of the oligonucleotide is longer than 27 nucleotides (e.g., 28, 29, 30, 31, 32, 33, 34, 35, 36, 37, 38, 39, 40, 41, 42, 43, 44, 45, 46, 47, 48, 49, or 50 nucleotides). In some embodiments, the sense strand of the oligonucleotide is longer than 25 nucleotides (e.g., 26, 27, 28, 29 or 30 nucleotides). In some embodiments, the sense strand of the oligonucleotide comprises a nucleotide sequence selected from SEQ ID NOs: 1537-1570, wherein the nucleotide sequence is longer than 27 nucleotides (e.g., 28, 29, 30, 31, 32, 33, 34, 35, 36, 37, 38, 39, 40, 41, 42, 43, 44, 45, 46, 47, 48, 49, or 50 nucleotides). In some embodiments, the sense strand of the oligonucleotide comprises a nucleotide sequence selected from SEQ ID NOs: 1537-1570, wherein the nucleotide sequence is longer than 25 nucleotides (e.g., 26, 27, 28, 29, or 30 nucleotides).

In some embodiments, oligonucleotides herein (e.g., RNAi oligonucleotides) have one 5' end that is thermodynamically less stable when compared to the other 5' end. In some embodiments, an asymmetric oligonucleotide is provided that includes a blunt end at the 3' end of a sense strand and a 3'-overhang at the 3' end of an antisense strand. In some embodiments, the 3'-overhang on the antisense strand is about 1-8 nucleotides in length (e.g., 1, 2, 3, 4, 5, 6, 7, or 8 nucleotides in length). In some embodiments, the oligonucleotide has an overhang comprising two (2) nucleotides on the 3' end of the antisense (guide) strand. However, other overhangs are possible. In some embodiments, an overhang is a 3'-overhang comprising a length of between 1 and 6 nucleotides, optionally 1 to 5, 1 to 4, 1 to 3, 1 to 2, 2 to 6, 2 to 5, 2 to 4, 2 to 3, 3 to 6, 3 to 5, 3 to 4, 4 to 6, 4 to 5, 5 to 6 nucleotides, or 1, 2, 3, 4, 5, or 6 nucleotides. However, in some embodiments, the overhang is a 5'-overhang comprising a length of between 1 and 6 nucleotides, optionally 1 to 5, 1 to 4, 1 to 3, 1 to 2, 2 to 6, 2 to 5, 2 to 4, 2 to 3, 3 to 6, 3 to 5, 3 to 4, 4 to 6, 4 to 5, 5 to 6 nucleotides, or 1, 2, 3, 4, 5, or 6 nucleotides. In some embodiments, the oligonucleotide comprises a targeting sequence or a region of complementary that is complementary to a contiguous sequence of nucleotides of any one of SEQ ID NOs: 1-384, and a 5'-overhang comprising a length of between 1 and 6 nucleotides. In some embodiments, the oligonucleotide comprises a sense strand comprising a nucleotide sequence selected from SEQ ID NOs: 1537-1570, wherein the oligonucleotide comprises a 5'-overhang comprising a length of between 1 and 6 nucleotides. In some embodiments, the oligonucleotide comprises an antisense strand comprising a nucleotide sequence selected from SEQ ID NOs: 1573-1606, wherein the oligonucleotide comprises a 5'-overhang comprising a length of between 1 and 6 nucleotides. In some embodiments, the oligonucleotide comprises a sense strand comprising a nucleotide sequence selected from SEQ ID NOs: 1537-1570 and antisense strand comprising a nucleotide sequence selected from SEQ ID NOs: 1573-1606, wherein the oligonucleotide comprises a 5'-overhang comprising a length of between 1 and 6 nucleotides.

In some embodiments, two (2) terminal nucleotides on the 3' end of an antisense strand are modified. In some embodiments, the two (2) terminal nucleotides on the 3' end of the antisense strand are complementary with the target mRNA (e.g., MARC1 mRNA). In some embodiments, the two (2) terminal nucleotides on the 3' end of the antisense strand are not complementary with the target mRNA. In some embodiments, the two (2) terminal nucleotides on the 3' end of the antisense strand of an oligonucleotide herein are unpaired. In some embodiments, the two (2) terminal nucleotides on the 3' end of the antisense strand of an oligonucleotide herein comprise an unpaired GG. In some embodiments, the two (2) terminal nucleotides on the 3' end of an antisense strand of an oligonucleotide herein are not complementary to the target mRNA. In some embodiments, two (2) terminal nucleotides on each 3' end of an oligonucleotide are GG. In some embodiments, one or both of the two (2) terminal GG nucleotides on each 3' end of an oligonucleotide herein is not complementary with the target mRNA. In some embodiments, the oligonucleotide comprises a targeting sequence or a region of complementary that is complementary to a contiguous sequence of nucleotides of any one of SEQ ID NOs: 1-384, wherein the two (2) terminal nucleotides on the 3' end of the antisense strand of the oligonucleotide herein comprises an unpaired GG. In some embodiments, the oligonucleotide comprises an antisense strand comprising a nucleotide sequence selected from SEQ ID NOs: 385-768, wherein the two (2) terminal nucleotides on the 3' end of the antisense strand of the oligonucleotide comprises an unpaired GG. In some embodiments, the oligonucleotide comprises a sense strand comprising a nucleotide sequence selected from SEQ ID NOs: 1537-1570 and antisense strand comprising a nucleotide sequence selected from SEQ ID NOs: 1573-1606, wherein the two (2) terminal nucleotides on the 3' end of the antisense strand of the oligonucleotide comprises an unpaired GG.

In some embodiments, there is one or more (e.g., 1, 2, 3, 4, or 5) mismatch(es) between a sense and antisense strand comprising an oligonucleotide herein (e.g., an RNAi oligonucleotide). If there is more than one mismatch between a sense and antisense strand, they may be positioned consecutively (e.g., 2, 3 or more in a row), or interspersed throughout the region of complementarity. In some embodiments, the 3' end of the sense strand comprises one or more mismatches. In some embodiments, two (2) mismatches are incorporated at the 3' end of the sense strand. In some embodiments, base mismatches, or destabilization of segments at the 3' end of the sense strand of an oligonucleotide herein improves or increases the potency of the oligonucleotide. In some embodiments, the sense and antisense strands of an oligonucleotide herein comprise nucleotides sequences selected from the group consisting of:

(a) SEQ ID NOs: 1537 and 1573, respectively;
(b) SEQ ID NOs: 1538 and 1574, respectively;
(c) SEQ ID NOs: 1539 and 1575, respectively;
(d) SEQ ID NOs: 1540 and 1576, respectively;
(e) SEQ ID NOs: 1541 and 1577, respectively;
(f) SEQ ID NOs: 1542 and 1578, respectively;
(g) SEQ ID NOs: 1543 and 1579, respectively;
(h) SEQ ID NOs: 1544 and 1580, respectively;
(i) SEQ ID NOs: 1545 and 1581, respectively;
(j) SEQ ID NOs: 1546 and 1582, respectively;
(k) SEQ ID NOs: 1547 and 1583, respectively;
(l) SEQ ID NOs: 1548 and 1584, respectively;
(m) SEQ ID NOs: 1549 and 1585, respectively;
(n) SEQ ID NOs: 1550 and 1586, respectively;
(o) SEQ ID NOs: 1551 and 1587, respectively;
(p) SEQ ID NOs: 1552 and 1588, respectively;
(q) SEQ ID NOs: 1553 and 1589, respectively;
(r) SEQ ID NOs: 1554 and 1590, respectively;
(s) SEQ ID NOs: 1555 and 1591, respectively;
(t) SEQ ID NOs: 1556 and 1592, respectively;
(u) SEQ ID NOs: 1557 and 1593, respectively;
(v) SEQ ID NOs: 1558 and 1594, respectively;
(w) SEQ ID NOs: 1559 and 1595, respectively;
(x) SEQ ID NOs: 1560 and 1596, respectively;
(y) SEQ ID NOs: 1561 and 1597, respectively;
(z) SEQ ID NOs: 1562 and 1598, respectively;
(aa) SEQ ID NOs: 1563 and 1599, respectively;
(bb) SEQ ID NOs: 1564 and 1600, respectively;
(cc) SEQ ID NOs: 1565 and 1601, respectively;
(dd) SEQ ID NOs: 1566 and 1602, respectively;
(ee) SEQ ID NOs: 1567 and 1603, respectively;
(ff) SEQ ID NOs: 1568 and 1604, respectively;
(gg) SEQ ID NOs: 1569 and 1605, respectively; and,
(hh) SEQ ID NOs: 1570 and 1606, respectively, wherein there is one or more (e.g., 1, 2, 3, 4, or 5) mismatch(es) between the sense and antisense strands.

In some embodiments, an oligonucleotide provided herein (e.g., an RNAi oligonucleotide) comprises a sense strand and an antisense strand comprising nucleotide sequences selected from:
(a) SEQ ID NOs: 1543 and 1579, respectively;
(b) SEQ ID NOs: 1560 and 1596, respectively;
(c) SEQ ID NOs: 1568 and 1604, respectively; and,
(d) SEQ ID NOs: 1553 and 1589, respectively,
wherein there is one or more (e.g., 1, 2, 3, 4, or 5) mismatch(es) between the sense and antisense strands.

Antisense Strands

In some embodiments, an antisense strand of an oligonucleotide herein (e.g., an RNAi oligonucleotide) is referred to as a "guide strand". For example, an antisense strand that engages with RNA-induced silencing complex (RISC) and binds to an Argonaute protein such as Ago2, or engages with or binds to one or more similar factors, and directs silencing of a target gene, as the antisense strand is referred to as a guide strand. In some embodiments, a sense strand comprising a region of complementary to a guide strand is referred to herein as a "passenger strand."

In some embodiments, an oligonucleotide herein (e.g., an RNAi oligonucleotide) comprises an antisense strand of up to about 50 nucleotides in length (e.g., up to 50, up to 40, up to 35, up to 30, up to 27, up to 25, up to 21, up to 19, up to 17, or up to 12 nucleotides in length). In some embodiments, an oligonucleotide comprises an antisense strand of at least about 12 nucleotides in length (e.g., at least 12, at least 15, at least 19, at least 21, at least 22, at least 25, at least 27, at least 30, at least 35, or at least 38 nucleotides in length). In some embodiments, an oligonucleotide comprises an antisense strand in a range of about 12 to about 40 (e.g., 12 to 40, 12 to 36, 12 to 32, 12 to 28, 15 to 40, 15 to 36, 15 to 32, 15 to 28, 17 to 22, 17 to 25, 19 to 27, 19 to 30, 20 to 40, 22 to 40, 25 to 40, or 32 to 40) nucleotides in length. In some embodiments, an oligonucleotide comprises antisense strand of 15 to 30 nucleotides in length. In some embodiments, an antisense strand of any one of the oligonucleotides disclosed herein is of 12, 13, 14, 15, 16, 17, 18, 19, 20, 21, 22, 23, 24, 25, 26, 27, 28, 29, 30, 31, 32, 33, 34, 35, 36, 37, 38, 39, or 40 nucleotides in length. In some embodiments, an oligonucleotide comprises an antisense strand of 22 nucleotides in length.

In some embodiments, an oligonucleotide disclosed herein (e.g., an RNAi oligonucleotide) for targeting MARC1 comprises an antisense strand comprising or consisting of a sequence as set forth in any one of SEQ ID NOs: 1153-1536. In some embodiments, an oligonucleotide herein comprises an antisense strand comprising at least about 12 (e.g., at least 12, at least 13, at least 14, at least 15, at least 16, at least 17, at least 18, at least 19, at least 20, at least 21, at least 22, or at least 23) contiguous nucleotides of a sequence as set forth in any one of SEQ ID NOs: 1153-1536. In some embodiments, an oligonucleotide disclosed herein for targeting MARC1 comprises an antisense strand comprising or consisting of a sequence as set forth in any one of SEQ ID NOs: 1573-1606. In some embodiments, an oligonucleotide herein comprises an antisense strand comprising at least about 12 (e.g., at least 12, at least 13, at least 14, at least 15, at least 16, at least 17, at least 18, at least 19, at least 20, at least 21, at least 22, or at least 23) contiguous nucleotides of a sequence as set forth in any one of SEQ ID NOs: 1573-1606. In some embodiments, an oligonucleotide disclosed herein for targeting MARC1 comprises an antisense strand comprising or consisting of a sequence as set forth in any one of SEQ ID NOs: 1579, 1596, 1604, and 1589. In some embodiments, an oligonucleotide herein comprises an antisense strand comprising at least about 12 (e.g., at least 12, at least 13, at least 14, at least 15, at least 16, at least 17, at least 18, at least 19, at least 20, at least 21, at least 22, or at least 23) contiguous nucleotides of a sequence as set forth in any one of SEQ ID NOs: 1579, 1596, 1604, and 1589.

In some embodiments, an oligonucleotide herein comprises an antisense strand comprising a nucleotide sequence selected from SEQ ID NOs: 385-768. In some embodiments, an oligonucleotide herein comprises an antisense strand comprising a nucleotide sequence selected from SEQ ID NOs: 618, 682, 740, and 760.

Sense Strands

In some embodiments, an oligonucleotide disclosed herein (e.g., an RNAi oligonucleotide) for targeting MARC1 mRNA and inhibiting MARC1 expression comprises a sense strand sequence as set forth in any one of SEQ ID NOs: 1-384. In some embodiments, an oligonucleotide disclosed herein (e.g., an RNAi oligonucleotide) for targeting MARC1 mRNA and inhibiting MARC1 expression comprises a sense strand sequence as set forth in any one of SEQ ID NOs: 769-1152. In some embodiments, an oligonucleotide herein has a sense strand comprised of at least about 12 (e.g., at least 13, at least 14, at least 15, at least 16, at least 17, at least 18, at least 19, at least 20, at least 21, at least 22, or at least 23) contiguous nucleotides of a sequence as set forth in any one of SEQ ID NOs: 769-1152. In some embodiments, an oligonucleotide herein has a sense strand comprised of at least about 12 (e.g., at least 13, at least 14, at least 15, at least 16, at least 17, at least 18, or at least 19) contiguous nucleotides of a sequence as set forth in any one of SEQ ID NOs: 1-384. In some embodiments, an oligonucleotide disclosed herein for targeting MARC1 mRNA and inhibiting MARC1 expression comprises a sense strand sequence as set forth in any one of SEQ ID NOs: 1537-1570. In some embodiments, an oligonucleotide herein has a sense strand comprised of least about 12 (e.g., at least 13, at least 14, at least 15, at least 16, at least 17, at least 18, at least 19, at least 20, at least 21, at least 22, or at least 23) contiguous nucleotides of a sequence as set forth in any one of SEQ ID NOs: 1537-1570. In some embodiments, an oligonucleotide disclosed herein for targeting MARC1 mRNA and inhibiting MARC1 expression comprises a sense strand sequence as set forth in any one of SEQ ID NOs: 1543, 1560, 1568, and 1553. In some embodiments, an oligonucleotide herein has a sense strand that comprise at least about 12 (e.g., at least 13, at least 14, at least 15, at least 16, at least 17, at least 18, at least 19, at least 20, at least 21, at least 22, or at least 23) contiguous nucleotides of a sequence as set forth in any one of SEQ ID NOs: 1543, 1560, 1568, or 1553. In some embodiments, an oligonucleotide disclosed herein for targeting MARC1 mRNA and inhibiting MARC1 expression comprises a sense strand sequence as set forth in any one of SEQ ID NOs: 234, 298, 356, and 376. In some embodiments, an oligonucleotide herein has a sense strand that comprise at least about 12 (e.g., at least 13, at least 14, at least 15, at least 16, at least 17, at least 18, or at least 19) contiguous nucleotides of a sequence as set forth in any one of SEQ ID NOs: 234, 298, 356, and 376.

In some embodiments, an oligonucleotide provided herein (e.g., an RNAi oligonucleotide) comprises a sense strand (or passenger strand) of up to about 50 nucleotides in length (e.g., up to 50, up to 40, up to 36, up to 30, up to 27, up to 25, up to 21, up to 19, up to 17, or up to 12 nucleotides in length). In some embodiments, an oligonucleotide herein comprises a sense strand of at least about 12 nucleotides in length (e.g., at least 12, at least 15, at least 19, at least 21, at least 25, at least 27, at least 30, at least 36 or at least 38 nucleotides in length). In some embodiments, an oligonucleotide herein comprises a sense strand in a range of about 12 to about 50 (e.g., 12 to 50, 12 to 40, 12 to 36, 12 to 32, 12 to 28, 15 to 40, 15 to 36, 15 to 32, 15 to 28, 17 to 21, 17 to 25, 19 to 27, 19 to 30, 20 to 40, 22 to 40, 25 to 40, or 32 to 40) nucleotides in length. In some embodiments, an oligonucleotide herein comprises a sense strand of 15 to 50 nucleotides in length. In some embodiments, an oligonucleotide herein comprises a sense strand of 18 to 36 nucleotides in length. In some embodiments, an oligonucleotide herein comprises a sense strand of 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides in length. In some embodiments, an oligonucleotide herein comprises a sense strand of 36 nucleotides in length.

In some embodiments, an oligonucleotide provided herein (e.g., an RNAi oligonucleotide) comprises a sense strand comprising a stem-loop structure at the 3' end of the sense strand. In some embodiments, the stem-loop is formed by intrastrand base pairing. In some embodiments, a sense strand comprises a stem-loop structure at its 5' end. In some embodiments, the stem of the stem-loop comprises a duplex of 2, 3, 4, 5, 6, 7, 8, 9, 10, 11, 12, 13, or 14 nucleotides in length. In some embodiments, the stem of the stem-loop comprises a duplex of 2 nucleotides in length. In some embodiments, the stem of the stem-loop comprises a duplex of 3 nucleotides in length. In some embodiments, the stem of the stem-loop comprises a duplex of 4 nucleotides in length. In some embodiments, the stem of the stem-loop comprises a duplex of 5 nucleotides in length. In some embodiments, the stem of the stem-loop comprises a duplex of 6 nucleotides in length. In some embodiments, the stem of the stem-loop comprises a duplex of 7 nucleotides in length. In some embodiments, the stem of the stem-loop comprises a duplex of 8 nucleotides in length. In some embodiments, the stem of the stem-loop comprises a duplex of 9 nucleotides in length. In some embodiments, the stem of the stem-loop comprises a duplex of 10 nucleotides in length. In some embodiments, the stem of the stem-loop comprises a duplex of 11 nucleotides in length. In some embodiments, the stem of the stem-loop comprises a duplex of 12 nucleotides in length. In some embodiments, the stem of the stem-loop comprises a duplex of 13 nucleotides in length. In some embodiments, the stem of the stem-loop comprises a duplex of 14 nucleotides in length.

In some embodiments, a stem-loop provides the oligonucleotide protection against degradation (e.g., enzymatic degradation), facilitates or improves targeting and/or delivery to a target cell, tissue, or organ (e.g., the liver), or both. For example, in some embodiments, the loop of a stem-loop is comprised of nucleotides comprising one or more modifications that facilitate, improve, or increase targeting to a target mRNA (e.g., a MARC1 mRNA), inhibition of target gene expression (e.g., MARC1 expression), and/or delivery, uptake, and/or penetrance into a target cell, tissue, or organ (e.g., the liver), or a combination thereof. In some embodiments, the stem-loop itself or modification(s) to the stem-loop do not affect or do not substantially affect the inherent gene expression inhibition activity of the oligonucleotide, but facilitates, improves, or increases stability (e.g., provides protection against degradation) and/or delivery, uptake, and/ or penetrance of the oligonucleotide to a target cell, tissue, or organ (e.g., the liver). In certain embodiments, an oligonucleotide herein comprises a sense strand comprising (e.g., at its 3' end) a stem-loop set forth as: S1-L-S2, in which S1 is complementary to S2, and in which L forms a single-stranded loop of linked nucleotides between S1 and S2 of up to about 10 nucleotides in length (e.g., 3, 4, 5, 6, 7, 8, 9, or 10 nucleotides in length). In some embodiments, the loop (L) is 3 nucleotides in length. In some embodiments, the loop (L) is 4 nucleotides in length. In some embodiments, the loop (L) is 5 nucleotides in length. In some embodiments, the loop (L) is 6 nucleotides in length. In some embodiments, the loop (L) is 7 nucleotides in length. In some embodiments, the loop (L) is 8 nucleotides in length. In some embodiments, the loop (L) is 9 nucleotides in length. In some embodiments, the loop (L) is 10 nucleotides in length.

In some embodiments, the tetraloop comprises the sequence 5'-GAAA-3'. In some embodiments, the stem loop comprises the sequence 5'-GCAGCCGAAAGGCUGC-3' (SEQ ID NO: 1681).

In some embodiments, an oligonucleotide provided herein (e.g., an RNAi oligonucleotide) comprises a targeting sequence or a region of complementary that is complementary to a contiguous sequence of nucleotides of any one of SEQ ID NOs: 1-384, and the oligonucleotide comprises a sense strand comprising (e.g., at its 3' end) a stem-loop set forth as: S1-L-S2, in which S1 is complementary to S2, and in which L forms a single-stranded loop between S1 and S2 of up to about 10 nucleotides in length (e.g., 3, 4, 5, 6, 7, 8, 9, or 10 nucleotides in length). In some embodiments, the oligonucleotide comprises a targeting sequence or a region of complementary that is complementary to a contiguous sequence of nucleotides of any one of SEQ ID NOs: 1-384, and the oligonucleotide comprises a sense strand comprising (e.g., at its 3' end) a stem-loop set forth as: S1-L-S2, in which S1 is complementary to S2, and in which L forms a single-stranded loop between S1 and S2 of 4 nucleotides in length.

In some embodiments, a loop (L) of a stem-loop having the structure S1-L-S2 as described herein is a triloop. In some embodiments, the oligonucleotide comprises a targeting sequence or a region of complementary that is complementary to a contiguous sequence of nucleotides of any one of SEQ ID NOs: 1-384 and a triloop. In some embodiments, the triloop comprises ribonucleotides, deoxyribonucleotides, modified nucleotides, ligands (e.g., delivery ligands), and combinations thereof.

In some embodiments, a loop (L) of a stem-loop having the structure S1-L-S2 as described above is a tetraloop as describe in U.S. Pat. No. 10,131,912, incorporated herein by reference. In some embodiments, an oligonucleotide herein comprises a targeting sequence or a region of complementary that is complementary to a contiguous sequence of nucleotides of any one of SEQ ID NOs: 1-384 and a tetraloop. In some embodiments, the tetraloop comprises ribonucleotides, deoxyribonucleotides, modified nucleotides, ligands (e.g., delivery ligands), and combinations thereof.

Duplex Length

In some embodiments, a duplex formed between a sense and antisense strand is at least 12 (e.g., at least 15, at least 16, at least 17, at least 18, at least 19, at least 20, or at least 21) nucleotides in length. In some embodiments, a duplex formed between a sense and antisense strand is in the range of 12-30 nucleotides in length (e.g., 12 to 30, 12 to 27, 12 to 22, 15 to 25, 18 to 30, 18 to 22, 18 to 25, 18 to 27, 18 to 30, 19 to 30, or 21 to 30 nucleotides in length). In some embodiments, a duplex formed between a sense and antisense strand is 12, 13, 14, 15, 16, 17, 18, 19, 29, 21, 22, 23, 24, 25, 26, 27, 28, 29, or 30 nucleotides in length. In some embodiments, a duplex formed between a sense and antisense strand is 12 nucleotides in length. In some embodiments, a duplex formed between a sense and antisense strand is 13 nucleotides in length. In some embodiments, a duplex formed between a sense and antisense strand is 14 nucleotides in length. In some embodiments, a duplex formed between a sense and antisense strand is 15 nucleotides in length. In some embodiments, a duplex formed between a sense and antisense strand is 16 nucleotides in length. In some embodiments, a duplex formed between a sense and antisense strand is 17 nucleotides in length. In some embodiments, a duplex formed between a sense and antisense strand is 18 nucleotides in length. In some embodiments, a duplex formed between a sense and antisense strand is 19 nucleotides in length. In some embodiments, a duplex formed between a sense and antisense strand is 20 nucleotides in length. In some embodiments, a duplex formed between a sense and antisense strand is 21 nucleotides in length. In some embodiments, a duplex formed between a sense and antisense strand is 22 nucleotides in length. In some embodiments, a duplex formed between a sense and antisense strand is 23 nucleotides in length. In some embodiments, a duplex formed between a sense and antisense strand is 24 nucleotides in length. In some embodiments, a duplex formed between a sense and antisense strand is 25 nucleotides in length. In some embodiments, a duplex formed between a sense and antisense strand is 26 nucleotides in length. In some embodiments, a duplex formed between a sense and antisense strand is 27 nucleotides in length. In some embodiments, a duplex formed between a sense and antisense strand is 28 nucleotides in length. In some embodiments, a duplex formed between a sense and antisense strand is 29 nucleotides in length. In some embodiments, a duplex formed between a sense and antisense strand is 30 nucleotides in length. In some embodiments, a duplex formed between a sense and antisense strand does not span the entire length of the sense strand and/or antisense strand. In some embodiments, a duplex between a sense and antisense strand spans the entire length of either the sense or antisense strands. In some embodiments, a duplex between a sense and antisense strand spans the entire length of both the sense strand and the antisense strand. In some embodiments, the sense and antisense strands of an oligonucleotide comprise nucleotides sequences selected from the group consisting of:

(a) SEQ ID NOs: 1537 and 1573, respectively;
(b) SEQ ID NOs: 1538 and 1574, respectively;
(c) SEQ ID NOs: 1539 and 1575, respectively;
(d) SEQ ID NOs: 1540 and 1576, respectively;
(e) SEQ ID NOs: 1541 and 1577, respectively;
(f) SEQ ID NOs: 1542 and 1578, respectively;
(g) SEQ ID NOs: 1543 and 1579, respectively;
(h) SEQ ID NOs: 1544 and 1580, respectively;
(i) SEQ ID NOs: 1545 and 1581, respectively;
(j) SEQ ID NOs: 1546 and 1582, respectively;
(k) SEQ ID NOs: 1547 and 1583, respectively;
(l) SEQ ID NOs: 1548 and 1584, respectively;
(m) SEQ ID NOs: 1549 and 1585, respectively;
(n) SEQ ID NOs: 1550 and 1586, respectively;
(o) SEQ ID NOs: 1551 and 1587, respectively;
(p) SEQ ID NOs: 1552 and 1588, respectively;
(q) SEQ ID NOs: 1553 and 1589, respectively;
(r) SEQ ID NOs: 1554 and 1590, respectively;
(s) SEQ ID NOs: 1555 and 1591, respectively;
(t) SEQ ID NOs: 1556 and 1592, respectively;
(u) SEQ ID NOs: 1557 and 1593, respectively;
(v) SEQ ID NOs: 1558 and 1594, respectively;

(w) SEQ ID NOs: 1559 and 1595, respectively;
(x) SEQ ID NOs: 1560 and 1596, respectively;
(y) SEQ ID NOs: 1561 and 1597, respectively;
(z) SEQ ID NOs: 1562 and 1598, respectively;
(aa) SEQ ID NOs: 1563 and 1599, respectively;
(bb) SEQ ID NOs: 1564 and 1600, respectively;
(cc) SEQ ID NOs: 1565 and 1601, respectively;
(dd) SEQ ID NOs: 1566 and 1602, respectively;
(ee) SEQ ID NOs: 1567 and 1603, respectively;
(ff) SEQ ID NOs: 1568 and 1604, respectively;
(gg) SEQ ID NOs: 1569 and 1605, respectively; and,
(hh) SEQ ID NOs: 1570 and 1606, respectively,
wherein a duplex formed between a sense and antisense strand is in the range of 12-30 nucleotides in length (e.g., 12 to 30, 12 to 27, 12 to 22, 15 to 25, 18 to 30, 18 to 22, 18 to 25, 18 to 27, 18 to 30, 19 to 30, or 21 to 30 nucleotides in length)

In some embodiments, a duplex between a sense and antisense strand spans the entire length of both the sense strand and the antisense strand. In some embodiments, the sense and antisense strands of an oligonucleotide comprise nucleotides sequences selected from the group consisting of:
(a) SEQ ID NOs: 1543 and 1579, respectively;
(b) SEQ ID NOs: 1560 and 1596, respectively;
(c) SEQ ID NOs: 1568 and 1604, respectively; and,
(d) SEQ ID NOs: 1553 and 1589, respectively,
wherein a duplex formed between a sense and antisense strand is in the range of 12-30 nucleotides in length (e.g., 12 to 30, 12 to 27, 12 to 22, 15 to 25, 18 to 30, 18 to 22, 18 to 25, 18 to 27, 18 to 30, 19 to 30, or 21 to 30 nucleotides in length)

Oligonucleotide Termini

In some embodiments, an oligonucleotide disclosed herein (e.g., an RNAi oligonucleotide) comprises a sense strand and an antisense strand, wherein the termini of either or both strands comprise a blunt end. In some embodiments, an oligonucleotide herein comprises sense and antisense strands that are separate strands which form an asymmetric duplex region having an overhang at the 3' terminus of the antisense strand. In some embodiments, an oligonucleotide herein comprises a sense strand and an antisense strand, wherein the termini of either or both strands comprise an overhang comprising one or more nucleotides. In some embodiments, the one or more nucleotides comprising the overhang are unpaired nucleotides. In some embodiments, an oligonucleotide herein comprises a sense strand and an antisense strand, wherein the 3' termini of the sense strand and the 5' termini of the antisense strand comprise a blunt end. In some embodiments, an oligonucleotide herein comprises a sense strand and an antisense strand, wherein the 5' termini of the sense strand and the 3' termini of the antisense strand comprise a blunt end.

In some embodiments, an oligonucleotide herein comprises a sense strand and an antisense strand, wherein the 3' terminus of either or both strands comprise a 3'-overhang comprising one or more nucleotides. In some embodiments, an oligonucleotide herein comprises a sense strand and an antisense strand, wherein the sense strand comprises a 3'-overhang comprising one or more nucleotides. In some embodiments, an oligonucleotide herein comprises a sense strand and an antisense strand, wherein the antisense strand comprises a 3'-overhang comprising one or more nucleotides. In some embodiments, an oligonucleotide herein comprises a sense strand and an antisense strand, wherein both the sense strand and the antisense strand comprises a 3'-overhang comprising one or more nucleotides.

In some embodiments, the 3'-overhang is about one (1) to twenty (20) nucleotides in length (e.g., about 1, 2, 3, 4, 5, 6, 7, 8, 9, 10, 11, 12, 13, 14, 15, 16, 17, 18, 19, or about 20 nucleotides in length). In some embodiments, the 3'-overhang is about one (1) to nineteen (19), one (1) to eighteen (18), one (1) to seventeen (17), one (1) to sixteen (16), one (1) to fifteen (15), one (1) to fourteen (14), one (1) to thirteen (13), one (1) to twelve (12), one (1) to eleven (11), one (1) to ten (10), one (1) to nine (9), one (1) to eight (8), one (1) to seven (7), one (1) to six (6), one (1) to five (5), one (1) to four (4), one (1) to three (3), or about one (1) to two (2) nucleotides in length. In some embodiments, the 3'-overhang is (1) nucleotide in length. In some embodiments, the 3'-overhang is two (2) nucleotides in length. In some embodiments, the 3'-overhang is three (3) nucleotides in length. In some embodiments, the 3'-overhang is four (4) nucleotides in length. In some embodiments, the 3'-overhang is five (5) nucleotides in length. In some embodiments, the 3'-overhang is six (6) nucleotides in length. In some embodiments, the 3'-overhang is seven (7) nucleotides in length. In some embodiments, the 3'-overhang is eight (8) nucleotides in length. In some embodiments, the 3'-overhang is nine (9) nucleotides in length. In some embodiments, the 3'-overhang is ten (10) nucleotides in length. In some embodiments, the 3'-overhang is eleven (11) nucleotides in length. In some embodiments, the 3'-overhang is twelve (12) nucleotides in length. In some embodiments, the 3'-overhang is thirteen (13) nucleotides in length. In some embodiments, the 3'-overhang is fourteen (14) nucleotides in length. In some embodiments, the 3'-overhang is fifteen (15) nucleotides in length. In some embodiments, the 3'-overhang is sixteen (16) nucleotides in length. In some embodiments, the 3'-overhang is seventeen (17) nucleotides in length. In some embodiments, the 3'-overhang is eighteen (18) nucleotides in length. In some embodiments, the 3'-overhang is nineteen (19) nucleotides in length. In some embodiments, the 3'-overhang is twenty (20) nucleotides in length.

In some embodiments, an oligonucleotide disclosed herein (e.g., an RNAi oligonucleotide) comprises a sense strand and an antisense strand, wherein the antisense strand comprises a 3'-overhang, wherein the sense and antisense strands of the oligonucleotide comprise nucleotides sequences selected from the group consisting of:
(a) SEQ ID NOs: 1537 and 1573, respectively;
(b) SEQ ID NOs: 1538 and 1574, respectively;
(c) SEQ ID NOs: 1539 and 1575, respectively;
(d) SEQ ID NOs: 1540 and 1576, respectively;
(e) SEQ ID NOs: 1541 and 1577, respectively;
(f) SEQ ID NOs: 1542 and 1578, respectively;
(g) SEQ ID NOs: 1543 and 1579, respectively;
(h) SEQ ID NOs: 1544 and 1580, respectively;
(i) SEQ ID NOs: 1545 and 1581, respectively;
(j) SEQ ID NOs: 1546 and 1582, respectively;
(k) SEQ ID NOs: 1547 and 1583, respectively;
(l) SEQ ID NOs: 1548 and 1584, respectively;
(m) SEQ ID NOs: 1549 and 1585, respectively;
(n) SEQ ID NOs: 1550 and 1586, respectively;
(o) SEQ ID NOs: 1551 and 1587, respectively;
(p) SEQ ID NOs: 1552 and 1588, respectively;
(q) SEQ ID NOs: 1553 and 1589, respectively;
(r) SEQ ID NOs: 1554 and 1590, respectively;
(s) SEQ ID NOs: 1555 and 1591, respectively;
(t) SEQ ID NOs: 1556 and 1592, respectively;
(u) SEQ ID NOs: 1557 and 1593, respectively;
(v) SEQ ID NOs: 1558 and 1594, respectively;
(w) SEQ ID NOs: 1559 and 1595, respectively;

(x) SEQ ID NOs: 1560 and 1596, respectively;
(y) SEQ ID NOs: 1561 and 1597, respectively;
(z) SEQ ID NOs: 1562 and 1598, respectively;
(aa) SEQ ID NOs: 1563 and 1599, respectively;
(bb) SEQ ID NOs: 1564 and 1600, respectively;
(cc) SEQ ID NOs: 1565 and 1601, respectively;
(dd) SEQ ID NOs: 1566 and 1602, respectively;
(ee) SEQ ID NOs: 1567 and 1603, respectively;
(ff) SEQ ID NOs: 1568 and 1604, respectively;
(gg) SEQ ID NOs: 1569 and 1605, respectively; and,
(hh) SEQ ID NOs: 1570 and 1606, respectively,
and wherein the antisense strand comprises a 3'-overhang about one (1) to twenty (20) nucleotides in length (e.g., about 1, 2, 3, 4, 5, 6, 7, 8, 9, 10, 11, 12, 13, 14, 15, 16, 17, 18, 19, or about 20 nucleotides in length), optionally wherein the 3'-overhang is two (2) nucleotides in length.

In some embodiments, an oligonucleotide disclosed herein (e.g., an RNAi oligonucleotide) comprises a sense strand and an antisense strand, wherein the antisense strand comprises a 3'-overhang, wherein the sense and antisense strands of the oligonucleotide comprise nucleotides sequences selected from the group consisting of:
(a) SEQ ID NOs: 1543 and 1579, respectively;
(b) SEQ ID NOs: 1560 and 1596, respectively;
(c) SEQ ID NOs: 1568 and 1604, respectively; and,
(d) SEQ ID NOs: 1553 and 1589, respectively,
and wherein the antisense strand comprises a 3'-overhang about one (1) to twenty (20) nucleotides in length (e.g., about 1, 2, 3, 4, 5, 6, 7, 8, 9, 10, 11, 12, 13, 14, 15, 16, 17, 18, 19, or about 20 nucleotides in length), optionally wherein the 3'-overhang is two (2) nucleotides in length.

In some embodiments, an oligonucleotide herein comprises a sense strand and an antisense strand, wherein the 5' terminus of either or both strands comprise a 5'-overhang comprising one or more nucleotides. In some embodiments, an oligonucleotide herein comprises a sense strand and an antisense strand, wherein the sense strand comprises a 5'-overhang comprising one or more nucleotides. In some embodiments, an oligonucleotide herein comprises a sense strand and an antisense strand, wherein the antisense strand comprises a 5'-overhang comprising one or more nucleotides. In some embodiments, an oligonucleotide herein comprises a sense strand and an antisense strand, wherein both the sense strand and the antisense strand comprises a 5'-overhang comprising one or more nucleotides.

In some embodiments, the 5'-overhang is about one (1) to twenty (20) nucleotides in length (e.g., about 1, 2, 3, 4, 5, 6, 7, 8, 9, 10, 11, 12, 13, 14, 15, 16, 17, 18, 19, or about 20 nucleotides in length). In some embodiments, the 5'-overhang is about one (1) to nineteen (19), one (1) to eighteen (18), one (1) to seventeen (17), one (1) to sixteen (16), one (1) to fifteen (15), one (1) to fourteen (14), one (1) to thirteen (13), one (1) to twelve (12), one (1) to eleven (11), one (1) to ten (10), one (1) to nine (9), one (1) to eight (8), one (1) to seven (7), one (1) to six (6), one (1) to five (5), one (1) to four (4), one (1) to three (3), or about one (1) to two (2) nucleotides in length. In some embodiments, the 5'-overhang is (1) nucleotide in length. In some embodiments, the 5'-overhang is two (2) nucleotides in length. In some embodiments, the 5'-overhang is three (3) nucleotides in length. In some embodiments, the 5'-overhang is four (4) nucleotides in length. In some embodiments, the 5'-overhang is five (5) nucleotides in length. In some embodiments, the 5'-overhang is six (6) nucleotides in length. In some embodiments, the 5'-overhang is seven (7) nucleotides in length. In some embodiments, the 5'-overhang is eight (8) nucleotides in length. In some embodiments, the 5'-overhang is nine (9) nucleotides in length. In some embodiments, the 5'-overhang is ten (10) nucleotides in length. In some embodiments, the 5'-overhang is eleven (11) nucleotides in length. In some embodiments, the 5'-overhang is twelve (12) nucleotides in length. In some embodiments, the 5'-overhang is thirteen (13) nucleotides in length. In some embodiments, the 5'-overhang is fourteen (14) nucleotides in length. In some embodiments, the 5'-overhang is fifteen (15) nucleotides in length. In some embodiments, the 5'-overhang is sixteen (16) nucleotides in length. In some embodiments, the 5'-overhang is seventeen (17) nucleotides in length. In some embodiments, the 5'-overhang is eighteen (18) nucleotides in length. In some embodiments, the 5'-overhang is nineteen (19) nucleotides in length. In some embodiments, the 5'-overhang is twenty (20) nucleotides in length.

In some embodiments, an oligonucleotide disclosed herein (e.g., an RNAi oligonucleotide) comprises a sense strand and an antisense strand, wherein the antisense strand comprises a 5'-overhang, wherein the sense and antisense strands of the oligonucleotide comprise nucleotides sequences selected from the group consisting of:
(a) SEQ ID NOs: 1537 and 1573, respectively;
(b) SEQ ID NOs: 1538 and 1574, respectively;
(c) SEQ ID NOs: 1539 and 1575, respectively;
(d) SEQ ID NOs: 1540 and 1576, respectively;
(e) SEQ ID NOs: 1541 and 1577, respectively;
(f) SEQ ID NOs: 1542 and 1578, respectively;
(g) SEQ ID NOs: 1543 and 1579, respectively;
(h) SEQ ID NOs: 1544 and 1580, respectively;
(i) SEQ ID NOs: 1545 and 1581, respectively;
(j) SEQ ID NOs: 1546 and 1582, respectively;
(k) SEQ ID NOs: 1547 and 1583, respectively;
(l) SEQ ID NOs: 1548 and 1584, respectively;
(m) SEQ ID NOs: 1549 and 1585, respectively;
(n) SEQ ID NOs: 1550 and 1586, respectively;
(o) SEQ ID NOs: 1551 and 1587, respectively;
(p) SEQ ID NOs: 1552 and 1588, respectively;
(q) SEQ ID NOs: 1553 and 1589, respectively;
(r) SEQ ID NOs: 1554 and 1590, respectively;
(s) SEQ ID NOs: 1555 and 1591, respectively;
(t) SEQ ID NOs: 1556 and 1592, respectively;
(u) SEQ ID NOs: 1557 and 1593, respectively;
(v) SEQ ID NOs: 1558 and 1594, respectively;
(w) SEQ ID NOs: 1559 and 1595, respectively;
(x) SEQ ID NOs: 1560 and 1596, respectively;
(y) SEQ ID NOs: 1561 and 1597, respectively;
(z) SEQ ID NOs: 1562 and 1598, respectively;
(aa) SEQ ID NOs: 1563 and 1599, respectively;
(bb) SEQ ID NOs: 1564 and 1600, respectively;
(cc) SEQ ID NOs: 1565 and 1601, respectively;
(dd) SEQ ID NOs: 1566 and 1602, respectively;
(ee) SEQ ID NOs: 1567 and 1603, respectively;
(ff) SEQ ID NOs: 1568 and 1604, respectively;
(gg) SEQ ID NOs: 1569 and 1605, respectively; and,
(hh) SEQ ID NOs: 1570 and 1606, respectively,
and wherein the antisense strand comprises a 5'-overhang about one (1) to twenty (20) nucleotides in length (e.g., about 1, 2, 3, 4, 5, 6, 7, 8, 9, 10, 11, 12, 13, 14, 15, 16, 17, 18, 19, or about 20 nucleotides in length), optionally wherein the 5'-overhang is two (2) nucleotides in length.

In some embodiments, an oligonucleotide disclosed herein (e.g., an RNAi oligonucleotide) comprises a sense strand and an antisense strand, wherein the antisense strand comprises a 5'-overhang, wherein the sense and antisense strands of the oligonucleotide comprise nucleotides sequences selected from the group consisting of:

(a) SEQ ID NOs: 1543 and 1579, respectively;
(b) SEQ ID NOs: 1560 and 1596, respectively;
(c) SEQ ID NOs: 1568 and 1604, respectively; and,
(d) SEQ ID NOs: 1553 and 1589, respectively,
and wherein the antisense strand comprises a 5'-overhang about one (1) to twenty (20) nucleotides in length (e.g., about 1, 2, 3, 4, 5, 6, 7, 8, 9, 10, 11, 12, 13, 14, 15, 16, 17, 18, 19, or about 20 nucleotides in length), optionally wherein the 5'-overhang is two (2) nucleotides in length.

In some embodiments, one or more (e.g., 2, 3, 4, 5, or more) nucleotides comprising the 3' terminus or 5' terminus of a sense and/or antisense strand are modified. For example, in some embodiments, one or two terminal nucleotides of the 3' terminus of the antisense strand are modified. In some embodiments, the last nucleotide at the 3' terminus of an antisense strand is modified, such that it comprises 2' modification, or it comprises, a 2'-O-methoxyethyl. In some embodiments, the last one or two terminal nucleotides at the 3' terminus of an antisense strand are complementary with the target. In some embodiments, the last one or two nucleotides at the 3' terminus of the antisense strand are not complementary with the target.

Figure 12:
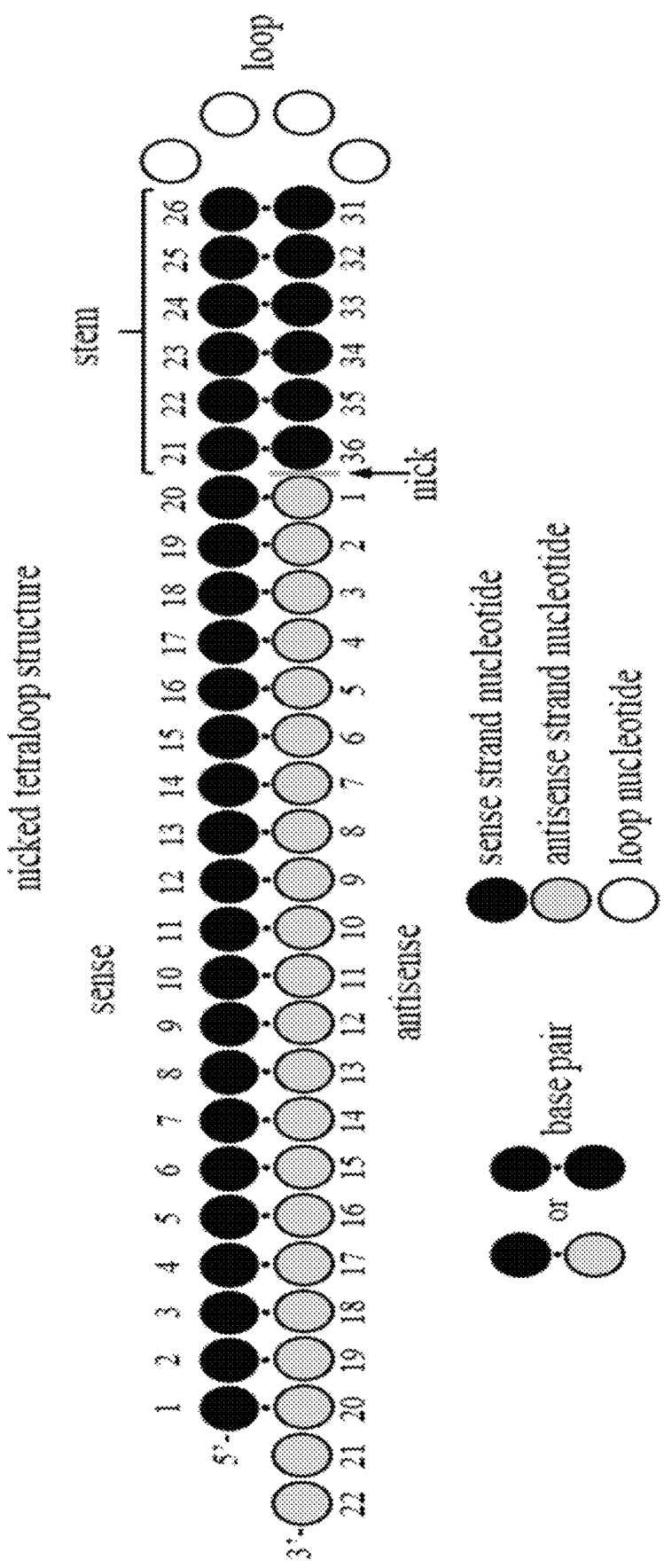
FIG. 12 is a schematic of an exemplary nicked tetraloop oligonucleotide structure.

In some embodiments, an oligonucleotide disclosed herein (e.g., an RNAi oligonucleotide) comprises a sense strand and an antisense strand, wherein the 3' terminus of the sense strand comprises a step-loop described herein and the 3' terminus of the antisense strand comprises a 3'-overhang described herein. In some embodiments, an oligonucleotide herein (e.g., an RNAi oligonucleotide) comprises a sense strand and an antisense strand that form a nicked tetraloop structure described herein, wherein the 3' terminus of the sense strand comprises a stem-loop, wherein the loop is a tetraloop described herein, and wherein the 3' terminus of the antisense strand comprises a 3'-overhang described herein. In some embodiments, the 3'-overhang is two (2) nucleotides in length. In some embodiments, the two (2) nucleotides comprising the 3'-overhang both comprise guanine (G) nucleobases. Typically, one or both of the nucleotides comprising the 3'-overhang of the antisense strand are not complementary with the target mRNA. An exemplary nicked tetraloop structure is provided in FIG. 12. In some embodiments, an oligonucleotide described herein comprises the nicked tetraloop structure shown in FIG. 12.

Oligonucleotide Modifications

In some embodiments, an oligonucleotide described herein (e.g., an RNAi oligonucleotide) comprises a modification. Oligonucleotides (e.g., RNAi oligonucleotides) may be modified in various ways to improve or control specificity, stability, delivery, bioavailability, resistance from nuclease degradation, immunogenicity, base-pairing properties, RNA distribution and cellular uptake and other features relevant to therapeutic or research use.

In some embodiments, the modification is a modified sugar. In some embodiments, the modification is a 5'-terminal phosphate group. In some embodiments, the modification is a modified internucleotide linkage. In some embodiments, the modification is a modified base.

In some embodiments, an oligonucleotide described herein can comprise any one of the modifications described herein or any combination thereof. For example, in some embodiments, an oligonucleotide described herein comprises at least one modified sugar, a 5'-terminal phosphate group, at least one modified internucleotide linkage, and at least one modified base. In some embodiments, the sense and antisense strands of an oligonucleotide comprise nucleotides sequences selected from the group consisting of:

(a) SEQ ID NOs: 1537 and 1573, respectively;
(b) SEQ ID NOs: 1538 and 1574, respectively;
(c) SEQ ID NOs: 1539 and 1575, respectively;
(d) SEQ ID NOs: 1540 and 1576, respectively;
(e) SEQ ID NOs: 1541 and 1577, respectively;
(f) SEQ ID NOs: 1542 and 1578, respectively;
(g) SEQ ID NOs: 1543 and 1579, respectively;
(h) SEQ ID NOs: 1544 and 1580, respectively;
(i) SEQ ID NOs: 1545 and 1581, respectively;
(j) SEQ ID NOs: 1546 and 1582, respectively;
(k) SEQ ID NOs: 1547 and 1583, respectively;
(l) SEQ ID NOs: 1548 and 1584, respectively;
(m) SEQ ID NOs: 1549 and 1585, respectively;
(n) SEQ ID NOs: 1550 and 1586, respectively;
(o) SEQ ID NOs: 1551 and 1587, respectively;
(p) SEQ ID NOs: 1552 and 1588, respectively;
(q) SEQ ID NOs: 1553 and 1589, respectively;
(r) SEQ ID NOs: 1554 and 1590, respectively;
(s) SEQ ID NOs: 1555 and 1591, respectively;
(t) SEQ ID NOs: 1556 and 1592, respectively;
(u) SEQ ID NOs: 1557 and 1593, respectively;
(v) SEQ ID NOs: 1558 and 1594, respectively;
(w) SEQ ID NOs: 1559 and 1595, respectively;
(x) SEQ ID NOs: 1560 and 1596, respectively;
(y) SEQ ID NOs: 1561 and 1597, respectively;
(z) SEQ ID NOs: 1562 and 1598, respectively;
(aa) SEQ ID NOs: 1563 and 1599, respectively;
(bb) SEQ ID NOs: 1564 and 1600, respectively;
(cc) SEQ ID NOs: 1565 and 1601, respectively;
(dd) SEQ ID NOs: 1566 and 1602, respectively;
(ee) SEQ ID NOs: 1567 and 1603, respectively;
(ff) SEQ ID NOs: 1568 and 1604, respectively;
(gg) SEQ ID NOs: 1569 and 1605, respectively; and,
(hh) SEQ ID NOs: 1570 and 1606, respectively,
wherein the oligonucleotide comprises at least one modified sugar, a 5'-terminal phosphate group, at least one modified internucleotide linkage, and at least one modified base.

In some embodiments, an oligonucleotide described herein comprises at least one modified sugar, a 5'-terminal phosphate group, at least one modified internucleotide linkage, and at least one modified base. In some embodiments, the sense and antisense strands of an oligonucleotide comprise nucleotides sequences selected from the group consisting of:

(a) SEQ ID NOs: 1543 and 1579, respectively;
(b) SEQ ID NOs: 1560 and 1596, respectively;
(c) SEQ ID NOs: 1568 and 1604, respectively; and,
(d) SEQ ID NOs: 1553 and 1589, respectively,
wherein the oligonucleotide comprises at least one modified sugar, a 5'-terminal phosphate group, at least one modified internucleotide linkage, and at least one modified base.

The number of modifications on an oligonucleotide (e.g., an RNAi oligonucleotide) and the position of those nucleotide modifications may influence the properties of an oligonucleotide. For example, oligonucleotides may be delivered in vivo by conjugating them to or encompassing them in a lipid nanoparticle (LNP) or similar carrier. However, when an oligonucleotide is not protected by an LNP or similar carrier, it may be advantageous for at least some of the nucleotides to be modified. Accordingly, in some embodiments, all or substantially all the nucleotides of an oligonucleotide are modified. In some embodiments, more than half of the nucleotides are modified. In some embodiments, less than half of the nucleotides are modified. In some embodiments, the sugar moiety of all nucleotides comprising the oligonucleotide is modified at the 2' position. The modifications may be reversible or irreversible. In some embodiments, an oligonucleotide as disclosed herein has a number and type of modified nucleotides sufficient to cause the desired characteristics (e.g., protection from enzymatic degradation, capacity to target a desired cell after in vivo administration, and/or thermodynamic stability).

Sugar Modifications

In some embodiments, an oligonucleotide described herein (e.g., an RNAi oligonucleotide) comprises a modified sugar. In some embodiments, a modified sugar (also referred herein to a sugar analog) includes a modified deoxyribose or ribose moiety in which, for example, one or more modifications occur at the 2', 3', 4', and/or 5' carbon position of the sugar. In some embodiments, a modified sugar may also include non-natural alternative carbon structures such as those present in locked nucleic acids ("LNA"; see, e.g., Koshkin et al. (1998) TETRAHEDON 54:3607-30), unlocked nucleic acids ("UNA"; see, e.g., Snead et al. (2013) MOL. THER-NUCL. ACIDS 2:e103) and bridged nucleic acids ("BNA"; see, e.g., Imanishi & Obika (2002) CHEM COMMUN. (CAMB) 21:1653-59).

In some embodiments, a nucleotide modification in a sugar comprises a 2'-modification. In some embodiments, a 2'-modification may be 2'-O-propargyl, 2'-O-propylamin, 2'-amino, 2'-ethyl, 2'-fluoro (2'-F), 2'-aminoethyl (EA), 2'-O-methyl (2'-OMe), 2'-O-methoxyethyl (2'-MOE), 2'-O-[2-(methylamino)-2-oxoethyl] (2'-O-NMA), or 2'-deoxy-2'-fluoro-β-d-arabinonucleic acid (2'-FANA). In some embodiments, the modification is 2'-F, 2'-OMe, or 2'-MOE. In some embodiments, a modification in a sugar comprises a modification of the sugar ring, which may comprise modification of one or more carbons of the sugar ring. For example, a modification of a sugar of a nucleotide may comprise a 2'-oxygen of a sugar is linked to a 1'-carbon or 4'-carbon of the sugar, or a 2'-oxygen is linked to the 1'-carbon or 4'-carbon via an ethylene or methylene bridge. In some embodiments, a modified nucleotide has an acyclic sugar that lacks a 2'-carbon to 3'-carbon bond. In some embodiments, a modified nucleotide has a thiol group, e.g., in the 4' position of the sugar.

In some embodiments, an oligonucleotide (e.g., an RNAi oligonucleotide) described herein comprises at least about 1 modified nucleotide (e.g., at least 1, at least 5, at least 10, at least 15, at least 20, at least 25, at least 30, at least 35, at least 40, at least 45, at least 50, at least 55, at least 60, or more). In some embodiments, the sense strand of the oligonucleotide comprises at least about 1 modified nucleotide (e.g., at least 1, at least 5, at least 10, at least 15, at least 20, at least 25, at least 30, at least 35, or more). In some embodiments, the antisense strand of the oligonucleotide comprises at least about 1 modified nucleotide (e.g., at least 1, at least 5, at least 10, at least 15, at least 20, or more).

In some embodiments, all the nucleotides of the sense strand of the oligonucleotide are modified. In some embodiments, all the nucleotides of the antisense strand of the oligonucleotide are modified. In some embodiments, all the nucleotides of the oligonucleotide (i.e., both the sense strand and the antisense strand) are modified. In some embodiments, the modified nucleotide comprises a 2'-modification (e.g., a 2'-F or 2'-OMe, 2'-MOE, and 2'-deoxy-2'-fluoro-β-d-arabinonucleic acid).

In some embodiments, the current invention provides oligonucleotides having different modification patterns. In some embodiments, an oligonucleotide herein comprises a sense strand having a modification pattern as set forth in the Examples and Sequence Listing and an antisense strand having a modification pattern as set forth in the Examples and Sequence Listing.

In some embodiments, an oligonucleotide disclosed herein (e.g., an RNAi oligonucleotide) comprises an antisense strand having nucleotides that are modified with 2'-F. In some embodiments, an oligonucleotide herein comprises an antisense strand comprising nucleotides that are modified with 2'-F and 2'-OMe. In some embodiments, an oligonucleotide disclosed herein comprises a sense strand having nucleotides that are modified with 2'-F. In some embodiments, an oligonucleotide disclosed herein comprises a sense strand comprises nucleotides that are modified with 2'-F and 2'-OMe.

In some embodiments, an oligonucleotide described herein comprises a sense strand with about 10-15%, 10%, 11%, 12%, 13%, 14%, or 15% of the nucleotides of the sense strand comprising a 2'-fluoro modification. In some embodiments, about 11% of the nucleotides of the sense strand comprise a 2-fluoro modification. In some embodiments, an oligonucleotide described herein comprises an antisense strand with about 25-35%, 25%, 26%, 27%, 28%, 29%, 30%, 31%, 32%, 33%, 34%, or 35% of the nucleotides of the antisense strand comprising a 2'-fluoro modification. In some embodiments, about 32% of the nucleotides of the antisense strand comprise a 2'-fluoro modification. In some embodiments, the oligonucleotide has about 15-25%, 15%, 16%, 17%, 18%, 19%, 20%, 21%, 22%, 23%, 24%, or 25% of its nucleotides comprising a 2'-fluoro modification. In some embodiments, about 19% of the nucleotides in the dsRNAi oligonucleotide comprise a 2'-fluoro modification.

In some embodiments, one or more of positions 8, 9, 10, or 11 of the sense strand is modified with a 2'-F group. In some embodiments, one or more of positions 3, 8, 9, 10, 12, 13, and 17 of the sense strand is modified with a 2'-F group. In some embodiments, one or more of positions 2, 3, 4, 5, 7, 10, and 14 of the antisense strand is modified with a 2'-F group. In some embodiments, one or more of positions 2, 3, 4, 5, 7, 8, 10, 14, 16, and 19 is modified with a 2'-F group. In some embodiments, the sugar moiety at each of nucleotides at positions 1-7 and 12-20 in the sense strand is modified with a 2'-OMe. In some embodiments, the sugar moiety at each of nucleotides at positions 1-7, 12-27, and 31-36 in the sense strand is modified with a 2'-OMe. In some embodiments, the sugar moiety at each of nucleotides at positions 6, 9, 11-13, 15, 17, 18, and 20-22 in the sense strand is modified with a 2'-OMe.

In some embodiments, the sense and antisense strands of an oligonucleotide comprise nucleotides sequences selected from the group consisting of:
(a) SEQ ID NOs: 1537 and 1573, respectively;
(b) SEQ ID NOs: 1538 and 1574, respectively;
(c) SEQ ID NOs: 1539 and 1575, respectively;
(d) SEQ ID NOs: 1540 and 1576, respectively;
(e) SEQ ID NOs: 1541 and 1577, respectively;
(f) SEQ ID NOs: 1542 and 1578, respectively;
(g) SEQ ID NOs: 1543 and 1579, respectively;
(h) SEQ ID NOs: 1544 and 1580, respectively;
(i) SEQ ID NOs: 1545 and 1581, respectively;
(j) SEQ ID NOs: 1546 and 1582, respectively;
(k) SEQ ID NOs: 1547 and 1583, respectively;
(l) SEQ ID NOs: 1548 and 1584, respectively;
(m) SEQ ID NOs: 1549 and 1585, respectively;
(n) SEQ ID NOs: 1550 and 1586, respectively;
(o) SEQ ID NOs: 1551 and 1587, respectively;
(p) SEQ ID NOs: 1552 and 1588, respectively;
(q) SEQ ID NOs: 1553 and 1589, respectively;
(r) SEQ ID NOs: 1554 and 1590, respectively;
(s) SEQ ID NOs: 1555 and 1591, respectively;
(t) SEQ ID NOs: 1556 and 1592, respectively;

(u) SEQ ID NOs: 1557 and 1593, respectively;
(v) SEQ ID NOs: 1558 and 1594, respectively;
(w) SEQ ID NOs: 1559 and 1595, respectively;
(x) SEQ ID NOs: 1560 and 1596, respectively;
(y) SEQ ID NOs: 1561 and 1597, respectively;
(z) SEQ ID NOs: 1562 and 1598, respectively;
(aa) SEQ ID NOs: 1563 and 1599, respectively;
(bb) SEQ ID NOs: 1564 and 1600, respectively;
(cc) SEQ ID NOs: 1565 and 1601, respectively;
(dd) SEQ ID NOs: 1566 and 1602, respectively;
(ee) SEQ ID NOs: 1567 and 1603, respectively;
(ff) SEQ ID NOs: 1568 and 1604, respectively;
(gg) SEQ ID NOs: 1569 and 1605, respectively; and,
(hh) SEQ ID NOs: 1570 and 1606, respectively,
wherein one or more of positions 8, 9, 10 or 11 of the sense strand is modified with a 2'-F group.

In some embodiments, the sense and antisense strands of an oligonucleotide comprise nucleotides sequences selected from the group consisting of:
(a) SEQ ID NOs: 1543 and 1579, respectively;
(b) SEQ ID NOs: 1560 and 1596, respectively;
(c) SEQ ID NOs: 1568 and 1604, respectively; and,
(d) SEQ ID NOs: 1553 and 1589, respectively,
wherein one or more of positions 8, 9, 10, or 11 of the sense strand is modified with a 2'-F group.

In some embodiments, an oligonucleotide provided herein comprises an antisense strand having the sugar moiety of each of the nucleotides at positions 2, 5, and 14 of the antisense strand modified with 2'-F and the sugar moiety of each of the remaining nucleotides of the antisense strand modified with a modification selected from the group consisting of 2'-O-propargyl, 2'-O-propylamin, 2'-amino, 2'-ethyl, 2'-aminoethyl (EA), 2'-O-methyl (2'-OMe), 2'-O-methoxyethyl (2'-MOE), 2'-O-[2-(methylamino)-2-oxo-ethyl] (2'-O-NMA), and 2'-deoxy-2'-fluoro-β-d-arabino-nucleic acid (2'-FANA).

In some embodiments, an oligonucleotide provided herein comprises an antisense strand having the sugar moiety of each of the nucleotides at positions 1, 2, 5, and 14 of the antisense strand modified with 2'-F and the sugar moiety of each of the remaining nucleotides of the antisense strand modified with a modification selected from the group consisting of 2'-O-propargyl, 2'-O-propylamin, 2'-amino, 2'-ethyl, 2'-aminoethyl (EA), 2'-O-methyl (2'-OMe), 2'-O-methoxyethyl (2'-MOE), 2'-O-[2-(methylamino)-2-oxo-ethyl] (2'-O-NMA), and 2'-deoxy-2'-fluoro-β-d-arabino-nucleic acid (2'-FANA).

In some embodiments, an oligonucleotide provided herein comprises an antisense strand having the sugar moiety of each of the nucleotides at positions 2, 4, 5, and 14 of the antisense strand modified with 2'-F and the sugar moiety of each of the remaining nucleotides of the antisense strand modified with a modification selected from the group consisting of 2'-O-propargyl, 2'-O-propylamin, 2'-amino, 2'-ethyl, 2'-aminoethyl (EA), 2'-O-methyl (2'-OMe), 2'-O-methoxyethyl (2'-MOE), 2'-O-[2-(methylamino)-2-oxo-ethyl] (2'-O-NMA), and 2'-deoxy-2'-fluoro-β-d-arabino-nucleic acid (2'-FANA).

In some embodiments, an oligonucleotide provided herein comprises an antisense strand having the sugar moiety of each of the nucleotides at positions 1, 2, 3, 5, 7, and 14 of the antisense strand modified with 2'-F and the sugar moiety of each of the remaining nucleotides of the antisense strand modified with a modification selected from the group consisting of 2'-O-propargyl, 2'-O-propylamin, 2'-amino, 2'-ethyl, 2'-aminoethyl (EA), 2'-O-methyl (2'-OMe), 2'-O-methoxyethyl (2'-MOE), 2'-O-[2-(methylamino)-2-oxo-ethyl] (2'-O-NMA), and 2'-deoxy-2'-fluoro-β-d-arabino-nucleic acid (2'-FANA).

In some embodiments, an oligonucleotide provided herein comprises an antisense strand having the sugar moiety of each of the nucleotides at positions 2, 3, 4, 5, 7, and 14 of the antisense strand modified with 2'-F and the sugar moiety of each of the remaining nucleotides of the antisense strand modified with a modification selected from the group consisting of 2'-O-propargyl, 2'-O-propylamin, 2'-amino, 2'-ethyl, 2'-aminoethyl (EA), 2'-O-methyl (2'-OMe), 2'-O-methoxyethyl (2'-MOE), 2'-O-[2-(methylamino)-2-oxo-ethyl] (2'-O-NMA), and 2'-deoxy-2'-fluoro-β-d-arabino-nucleic acid (2'-FANA).

In some embodiments, an oligonucleotide provided herein comprises an antisense strand having the sugar moiety of each of the nucleotides at positions 1, 2, 3, 5, 10, and 14 of the antisense strand modified with 2'-F and the sugar moiety of each of the remaining nucleotides of the antisense strand modified with a modification selected from the group consisting of 2'-O-propargyl, 2'-O-propylamin, 2'-amino, 2'-ethyl, 2'-aminoethyl (EA), 2'-O-methyl (2'-OMe), 2'-O-methoxyethyl (2'-MOE), 2'-O-[2-(methylamino)-2-oxo-ethyl] (2'-O-NMA), and 2'-deoxy-2'-fluoro-β-d-arabino-nucleic acid (2'-FANA).

In some embodiments, an oligonucleotide provided herein comprises an antisense strand having the sugar moiety of each of the nucleotides at positions 2, 3, 4, 5, 10, and 14 of the antisense strand modified with 2'-F and the sugar moiety of each of the remaining nucleotides of the antisense strand modified with a modification selected from the group consisting of 2'-O-propargyl, 2'-O-propylamin, 2'-amino, 2'-ethyl, 2'-aminoethyl (EA), 2'-O-methyl (2'-OMe), 2'-O-methoxyethyl (2'-MOE), 2'-O-[2-(methylamino)-2-oxo-ethyl] (2'-O-NMA), and 2'-deoxy-2'-fluoro-β-d-arabino-nucleic acid (2'-FANA).

In some embodiments, an oligonucleotide provided herein comprises an antisense strand having the sugar moiety of each of the nucleotides at positions 2, 3, 5, 7, 10, and 14 of the antisense strand modified with 2'-F and the sugar moiety of each of the remaining nucleotides of the antisense strand modified with a modification selected from the group consisting of 2'-O-propargyl, 2'-O-propylamin, 2'-amino, 2'-ethyl, 2'-aminoethyl (EA), 2'-O-methyl (2'-OMe), 2'-O-methoxyethyl (2'-MOE), 2'-O-[2-(methylamino)-2-oxo-ethyl] (2'-O-NMA), and 2'-deoxy-2'-fluoro-β-d-arabino-nucleic acid (2'-FANA).

In some embodiments, an oligonucleotide provided herein comprises an antisense strand having the sugar moiety of each of the nucleotides at positions 2, 3, 4, 5, 7, 10, and 14 of the antisense strand modified with 2'-F and the sugar moiety of each of the remaining nucleotides of the antisense strand modified with a modification selected from the group consisting of 2'-O-propargyl, 2'-O-propylamin, 2'-amino, 2'-ethyl, 2'-aminoethyl (EA), 2'-O-methyl (2'-OMe), 2'-O-methoxyethyl (2'-MOE), 2'-O-[2-(methylamino)-2-oxo-ethyl] (2'-O-NMA), and 2'-deoxy-2'-fluoro-β-d-arabino-nucleic acid (2'-FANA).

In some embodiments, an oligonucleotide provided herein comprises an antisense strand having the sugar moiety of each of the nucleotides at positions 2, 3, 4, 5, 7, 8, 10, 14, 16, and, 19 of the antisense strand modified with 2'-F and the sugar moiety of each of the remaining nucleotides of the antisense strand modified with a modification selected from the group consisting of 2'-O-propargyl, 2'-O-propylamin, 2'-amino, 2'-ethyl, 2'-aminoethyl (EA), 2'-O-methyl (2'-OMe), 2'-O-methoxyethyl (2'-MOE), 2'-O-[2-(methylamino)-2-oxoethyl] (2'-O-NMA), and 2'-deoxy-2'-fluoro-β-d-arabinonucleic acid (2'-FANA).

In some embodiments, an oligonucleotide provided herein comprises an antisense strand having the sugar moiety at position 1, position 2, position 3, position 4, position 5, position 6, position 7, position 8, position 9, position 10, position 11, position 12, position 13, position 14, position 15, position 16, position 17, position 18, position 19, position 20, position 21, or position 22 modified with 2'-F.

In some embodiments, an oligonucleotide provided herein comprises an antisense strand having the sugar moiety at position 1, position 2, position 3, position 4, position 5, position 6, position 7, position 8, position 9, position 10, position 11, position 12, position 13, position 14, position 15, position 16, position 17, position 18, position 19, position 20, position 21, or position 22 modified with 2'-OMe.

In some embodiments, an oligonucleotide provided herein comprises an antisense strand having the sugar moiety at position 1, position 2, position 3, position 4, position 5, position 6, position 7, position 8, position 9, position 10, position 11, position 12, position 13, position 14, position 15, position 16, position 17, position 18, position 19, position 20, position 21, or position 22 modified with a modification selected from the group consisting of 2'-O-propargyl, 2'-O-propylamin, 2'-amino, 2'-ethyl, 2'-aminoethyl (EA), 2'-O-methyl (2'-OMe), 2'-O-methoxyethyl (2'-MOE), 2'-O-[2-(methylamino)-2-oxoethyl] (2'-O-NMA), and 2'-deoxy-2'-fluoro-β-d-arabinonucleic acid (2'-FANA).

In some embodiments, an oligonucleotide provided herein comprises a sense strand having the sugar moiety at positions 8-11 modified with 2'-F. In some embodiments, an oligonucleotide provided herein comprises a sense strand having the sugar moiety at positions 3, 8, 9, 10, 12, 13 and 17 modified with 2'-F. In some embodiments, an oligonucleotide provided herein comprises a sense strand having the sugar moiety at positions 1-7 and 12-17, or 12-20 modified with 2'OMe. In some embodiments, an oligonucleotide provided herein comprises a sense strand having the sugar moiety at positions 1-7, 12-27, and 31-36 modified with 2'OMe. In some embodiments, an oligonucleotide provided herein comprises a sense strand having the sugar moiety of each of the nucleotides at positions 1-7 and 12-17, or 12-20 of the sense strand modified with a modification selected from the group consisting of 2'-O-propargyl, 2'-O-propylamin, 2'-amino, 2'-ethyl, 2'-aminoethyl (EA), 2'-O-methyl (2'-OMe), 2'-O-methoxyethyl (2'-MOE), 2'-O-[2-(methylamino)-2-oxoethyl] (2'-O-NMA), and 2'-deoxy-2'-fluoro-β-d-arabinonucleic acid (2'-FANA). In some embodiments, an oligonucleotide provided herein comprises a sense strand having the sugar moiety at positions 1-2, 4-7, 11, 14-16, and 18-20 modified with 2'OMe. In some embodiments, an oligonucleotide provided herein comprises a sense strand having the sugar moiety of each of the nucleotides at positions 1-2, 4-7, 11, 14-16, and 18-20 of the sense strand modified with a modification selected from the group consisting of 2'-O-propargyl, 2'-O-propylamin, 2'-amino, 2'-ethyl, 2'-aminoethyl (EA), 2'-O-methyl (2'-OMe), 2'-O-methoxyethyl (2'-MOE), 2'-O-[2-(methylamino)-2-oxoethyl] (2'-O-NMA), and 2'-deoxy-2'-fluoro-β-d-arabinonucleic acid (2'-FANA).

In some embodiments, an oligonucleotide provided herein comprises a sense strand having the sugar moiety at position 1, position 2, position 3, position 4, position 5, position 6, position 7, position 8, position 9, position 10, position 11, position 12, position 13, position 14, position 15, position 16, position 17, position 18, position 19, position 20, position 21, position 22, position 23, position 24, position 25, position 26, position 27, position 28, position 29, position 30, position 31, position 32, position 33, position 34, position 35, or position 36 modified with 2'-F.

In some embodiments, an oligonucleotide provided herein comprises a sense strand having the sugar moiety at position 1, position 2, position 3, position 4, position 5, position 6, position 7, position 8, position 9, position 10, position 11, position 12, position 13, position 14, position 15, position 16, position 17, position 18, position 19, position 20, position 21, position 22, position 23, position 24, position 25, position 26, position 27, position 28, position 29, position 30, position 31, position 32, position 33, position 34, position 35, or position 36 modified with 2'-OMe.

In some embodiments, an oligonucleotide provided herein comprises a sense strand having the sugar moiety at position 1, position 2, position 3, position 4, position 5, position 6, position 7, position 8, position 9, position 10, position 11, position 12, position 13, position 14, position 15, position 16, position 17, position 18, position 19, position 20, position 21, position 22, position 23, position 24, position 25, position 26, position 27, position 28, position 29, position 30, position 31, position 32, position 33, position 34, position 35, or position 36 modified with a modification selected from the group consisting of 2'-O-propargyl, 2'-O-propylamin, 2'-amino, 2'-ethyl, 2'-aminoethyl (EA), 2'-O-methyl (2'-OMe), 2'-O-methoxyethyl (2'-MOE), 2'-O-[2-(methylamino)-2-oxoethyl] (2'-O-NMA), and 2'-deoxy-2'-fluoro-β-d-arabinonucleic acid (2'-FANA).

5'-Terminal Phosphate

In some embodiments, an oligonucleotide described herein (e.g., an RNAi oligonucleotide) comprises a sense strand and an antisense strand, wherein the antisense strand comprises a 5'-terminal phosphate. In some embodiments, 5'-terminal phosphate groups of an RNAi oligonucleotide enhance the interaction with Ago2. However, oligonucleotides comprising a 5'-phosphate group may be susceptible to degradation via phosphatases or other enzymes, which can limit their performance and/or bioavailability in vivo. In some embodiments, an oligonucleotide herein includes analogs of 5'-phosphates that are resistant to such degradation. In some embodiments, the phosphate analog is oxymethyl phosphonate, vinylphosphonate or malonylphosphonate, or a combination thereof. In certain embodiments, the 5' terminus of an oligonucleotide strand is attached to chemical moiety that mimics the electrostatic and steric properties of a natural 5'-phosphate group ("phosphate mimic"). In some embodiments, the sense and antisense strands of an oligonucleotide comprise nucleotides sequences selected from the group consisting of:

(a) SEQ ID NOs: 1537 and 1573, respectively;
(b) SEQ ID NOs: 1538 and 1574, respectively;
(c) SEQ ID NOs: 1539 and 1575, respectively;
(d) SEQ ID NOs: 1540 and 1576, respectively;
(e) SEQ ID NOs: 1541 and 1577, respectively;
(f) SEQ ID NOs: 1542 and 1578, respectively;
(g) SEQ ID NOs: 1543 and 1579, respectively;
(h) SEQ ID NOs: 1544 and 1580, respectively;
(i) SEQ ID NOs: 1545 and 1581, respectively;
(j) SEQ ID NOs: 1546 and 1582, respectively;
(k) SEQ ID NOs: 1547 and 1583, respectively;
(l) SEQ ID NOs: 1548 and 1584, respectively;
(m) SEQ ID NOs: 1549 and 1585, respectively;
(n) SEQ ID NOs: 1550 and 1586, respectively;
(o) SEQ ID NOs: 1551 and 1587, respectively;
(p) SEQ ID NOs: 1552 and 1588, respectively;
(q) SEQ ID NOs: 1553 and 1589, respectively;
(r) SEQ ID NOs: 1554 and 1590, respectively;

(s) SEQ ID NOs: 1555 and 1591, respectively;
(t) SEQ ID NOs: 1556 and 1592, respectively;
(u) SEQ ID NOs: 1557 and 1593, respectively;
(v) SEQ ID NOs: 1558 and 1594, respectively;
(w) SEQ ID NOs: 1559 and 1595, respectively;
(x) SEQ ID NOs: 1560 and 1596, respectively;
(y) SEQ ID NOs: 1561 and 1597, respectively;
(z) SEQ ID NOs: 1562 and 1598, respectively;
(aa) SEQ ID NOs: 1563 and 1599, respectively;
(bb) SEQ ID NOs: 1564 and 1600, respectively;
(cc) SEQ ID NOs: 1565 and 1601, respectively;
(dd) SEQ ID NOs: 1566 and 1602, respectively;
(ee) SEQ ID NOs: 1567 and 1603, respectively;
(ff) SEQ ID NOs: 1568 and 1604, respectively;
(gg) SEQ ID NOs: 1569 and 1605, respectively; and,
(hh) SEQ ID NOs: 1570 and 1606, respectively,
wherein the oligonucleotide comprises a 5'-terminal phosphate, optionally a 5'-terminal phosphate analog.

In some embodiments, the sense and antisense strands of an oligonucleotide comprise nucleotides sequences selected from the group consisting of:
(a) SEQ ID NOs: 1543 and 1579, respectively;
(b) SEQ ID NOs: 1560 and 1596, respectively;
(c) SEQ ID NOs: 1568 and 1604, respectively; and,
(d) SEQ ID NOs: 1553 and 1589, respectively,
wherein the oligonucleotide comprises a 5'-terminal phosphate, optionally a 5'-terminal phosphate analog.

In some embodiments, an oligonucleotide herein (e.g., an RNAi oligonucleotide) has a phosphate analog at a 4'-carbon position of the sugar (referred to as a "4'-phosphate analog"). See, e.g., Intl. Patent Application Publication No. WO 2018/045317. In some embodiments, an oligonucleotide herein comprises a 4'-phosphate analog at a 5'-terminal nucleotide. In some embodiments, a phosphate analog is an oxymethyl phosphonate, in which the oxygen atom of the oxymethyl group is bound to the sugar moiety (e.g., at its 4'-carbon) or analog thereof. In other embodiments, a 4'-phosphate analog is a thiomethyl phosphonate or an aminomethyl phosphonate, in which the sulfur atom of the thiomethyl group or the nitrogen atom of the amino methyl group is bound to the 4'-carbon of the sugar moiety or analog thereof. In certain embodiments, a 4'-phosphate analog is an oxymethyl phosphonate. In some embodiments, an oxymethyl phosphonate is represented by the formula —O—CH₂—PO(OH)₂, —O—CH₂—PO(OR)₂, or —O—CH₂—PO(OH)(R), in which R is independently selected from —H, —CH₃, an alkyl group, —CH₂CH₂CN, —CH₂OCOC(CH₃)₃, —CH₂OCH₂CH₂Si(CH₃)₃ or a protecting group. In certain embodiments, the alkyl group is CH₂CH₃. More typically, R is independently selected from —H, —CH₃ or —CH₂CH₃. In some embodiment, R is —CH₃. In some embodiments, the 4'-phosphate analog is 5'-methoxyphosphonate-4'-oxy.

In some embodiments, an oligonucleotide provided herein comprises an antisense strand comprising a 4'-phosphate analog at the 5'-terminal nucleotide, wherein 5'-terminal nucleotide comprises the following structure:

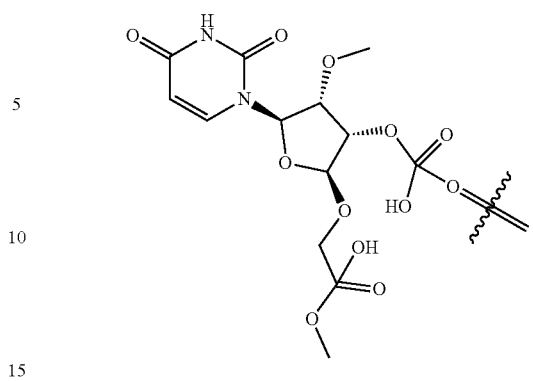

5'-methoxyphosphonate-4'-oxy-2'-O-methyluridine phosphorothioate [MePhosphonate-40-mUs].

Modified Internucleotide Linkage

In some embodiments, an oligonucleotide provided herein (e.g., a RNAi oligonucleotide) comprises a modified internucleotide linkage. In some embodiments, phosphate modifications or substitutions result in an oligonucleotide that comprises at least about 1 (e.g., at least 1, at least 2, at least 3, or at least 5) modified internucleotide linkage. In some embodiments, any one of the oligonucleotides disclosed herein comprises about 1 to about 10 (e.g., 1 to 10, 2 to 8, 4 to 6, 3 to 10, 5 to 10, 1 to 5, 1 to 3, or 1 to 2) modified internucleotide linkages. In some embodiments, any one of the oligonucleotides disclosed herein comprises 1, 2, 3, 4, 5, 6, 7, 8, 9, or 10 modified internucleotide linkages.

A modified internucleotide linkage may be a phosphorodithioate linkage, a phosphorothioate linkage, a phosphotriester linkage, a thionoalkylphosphonate linkage, a thionalkylphosphotriester linkage, a phosphoramidite linkage, a phosphonate linkage or a boranophosphate linkage. In some embodiments, at least one modified internucleotide linkage of any one of the oligonucleotides as disclosed herein is a phosphorothioate linkage.

In some embodiments, an oligonucleotide provided herein (e.g., a RNAi oligonucleotide) has a phosphorothioate linkage between one or more of positions 1 and 2 of the sense strand, positions 1 and 2 of the antisense strand, positions 2 and 3 of the antisense strand, positions 3 and 4 of the antisense strand, positions 20 and 21 of the antisense strand, and positions 21 and 22 of the antisense strand. In some embodiments, the oligonucleotide described herein has a phosphorothioate linkage between each of positions 1 and 2 of the sense strand, positions 1 and 2 of the antisense strand, positions 2 and 3 of the antisense strand, positions 20 and 21 of the antisense strand, and positions 21 and 22 of the antisense strand. In some embodiments, the sense and antisense strands of an oligonucleotide comprise nucleotides sequences selected from the group consisting of:
(a) SEQ ID NOs: 1537 and 1573, respectively;
(b) SEQ ID NOs: 1538 and 1574, respectively;
(c) SEQ ID NOs: 1539 and 1575, respectively;
(d) SEQ ID NOs: 1540 and 1576, respectively;
(e) SEQ ID NOs: 1541 and 1577, respectively;
(f) SEQ ID NOs: 1542 and 1578, respectively;
(g) SEQ ID NOs: 1543 and 1579, respectively;
(h) SEQ ID NOs: 1544 and 1580, respectively;
(i) SEQ ID NOs: 1545 and 1581, respectively;
(j) SEQ ID NOs: 1546 and 1582, respectively;
(k) SEQ ID NOs: 1547 and 1583, respectively;
(l) SEQ ID NOs: 1548 and 1584, respectively;
(m) SEQ ID NOs: 1549 and 1585, respectively;

(n) SEQ ID NOs: 1550 and 1586, respectively;
(o) SEQ ID NOs: 1551 and 1587, respectively;
(p) SEQ ID NOs: 1552 and 1588, respectively;
(q) SEQ ID NOs: 1553 and 1589, respectively;
(r) SEQ ID NOs: 1554 and 1590, respectively;
(s) SEQ ID NOs: 1555 and 1591, respectively;
(t) SEQ ID NOs: 1556 and 1592, respectively;
(u) SEQ ID NOs: 1557 and 1593, respectively;
(v) SEQ ID NOs: 1558 and 1594, respectively;
(w) SEQ ID NOs: 1559 and 1595, respectively;
(x) SEQ ID NOs: 1560 and 1596, respectively;
(y) SEQ ID NOs: 1561 and 1597, respectively;
(z) SEQ ID NOs: 1562 and 1598, respectively;
(aa) SEQ ID NOs: 1563 and 1599, respectively;
(bb) SEQ ID NOs: 1564 and 1600, respectively;
(cc) SEQ ID NOs: 1565 and 1601, respectively;
(dd) SEQ ID NOs: 1566 and 1602, respectively;
(ee) SEQ ID NOs: 1567 and 1603, respectively;
(ff) SEQ ID NOs: 1568 and 1604, respectively;
(gg) SEQ ID NOs: 1569 and 1605, respectively; and,
(hh) SEQ ID NOs: 1570 and 1606, respectively,
wherein the oligonucleotide comprises a modified internucleotide linkage.

In some embodiments, the oligonucleotide described herein has a phosphorothioate linkage between each of positions 1 and 2 of the sense strand, positions 1 and 2 of the antisense strand, positions 2 and 3 of the antisense strand, positions 20 and 21 of the antisense strand, and positions 21 and 22 of the antisense strand. In some embodiments, the sense and antisense strands of an oligonucleotide comprise nucleotides sequences selected from the group consisting of:
(a) SEQ ID NOs: 1543 and 1579, respectively;
(b) SEQ ID NOs: 1560 and 1596, respectively;
(c) SEQ ID NOs: 1568 and 1604, respectively; and,
(d) SEQ ID NOs: 1553 and 1589, respectively,
wherein the oligonucleotide comprises a modified internucleotide linkage.

Base Modifications

In some embodiments, an oligonucleotide provided herein (e.g., an RNAi oligonucleotides) comprises one or more modified nucleobases. In some embodiments, modified nucleobases (also referred to herein as base analogs) are linked at the 1' position of a nucleotide sugar moiety. In certain embodiments, a modified nucleobase is a nitrogenous base. In some embodiments, a modified nucleobase does not contain nitrogen atom. See, e.g., US Patent Application Publication No. 2008/0274462. In some embodiments, a modified nucleotide comprises a universal base. In some embodiments, a modified nucleotide does not contain a nucleobase (abasic). In some embodiments, the sense and antisense strands of an oligonucleotide comprise nucleotides sequences selected from the group consisting of:
(a) SEQ ID NOs: 1537 and 1573, respectively;
(b) SEQ ID NOs: 1538 and 1574, respectively;
(c) SEQ ID NOs: 1539 and 1575, respectively;
(d) SEQ ID NOs: 1540 and 1576, respectively;
(e) SEQ ID NOs: 1541 and 1577, respectively;
(f) SEQ ID NOs: 1542 and 1578, respectively;
(g) SEQ ID NOs: 1543 and 1579, respectively;
(h) SEQ ID NOs: 1544 and 1580, respectively;
(i) SEQ ID NOs: 1545 and 1581, respectively;
(j) SEQ ID NOs: 1546 and 1582, respectively;
(k) SEQ ID NOs: 1547 and 1583, respectively;
(l) SEQ ID NOs: 1548 and 1584, respectively;
(m) SEQ ID NOs: 1549 and 1585, respectively;
(n) SEQ ID NOs: 1550 and 1586, respectively;
(o) SEQ ID NOs: 1551 and 1587, respectively;
(p) SEQ ID NOs: 1552 and 1588, respectively;
(q) SEQ ID NOs: 1553 and 1589, respectively;
(r) SEQ ID NOs: 1554 and 1590, respectively;
(s) SEQ ID NOs: 1555 and 1591, respectively;
(t) SEQ ID NOs: 1556 and 1592, respectively;
(u) SEQ ID NOs: 1557 and 1593, respectively;
(v) SEQ ID NOs: 1558 and 1594, respectively;
(w) SEQ ID NOs: 1559 and 1595, respectively;
(x) SEQ ID NOs: 1560 and 1596, respectively;
(y) SEQ ID NOs: 1561 and 1597, respectively;
(z) SEQ ID NOs: 1562 and 1598, respectively;
(aa) SEQ ID NOs: 1563 and 1599, respectively;
(bb) SEQ ID NOs: 1564 and 1600, respectively;
(cc) SEQ ID NOs: 1565 and 1601, respectively;
(dd) SEQ ID NOs: 1566 and 1602, respectively;
(ee) SEQ ID NOs: 1567 and 1603, respectively;
(ff) SEQ ID NOs: 1568 and 1604, respectively;
(gg) SEQ ID NOs: 1569 and 1605, respectively; and,
(hh) SEQ ID NOs: 1570 and 1606, respectively,
wherein the oligonucleotide comprises one or more modified nucleobases.

In some embodiments, a modified nucleotide comprises a universal base. In some embodiments, a modified nucleotide does not contain a nucleobase (abasic). In some embodiments, the sense and antisense strands of an oligonucleotide comprise nucleotides sequences selected from the group consisting of:
(a) SEQ ID NOs: 1543 and 1579, respectively;
(b) SEQ ID NOs: 1560 and 1596, respectively;
(c) SEQ ID NOs: 1568 and 1604, respectively; and,
(d) SEQ ID NOs: 1553 and 1589, respectively,
wherein the oligonucleotide comprises one or more modified nucleobases.

In some embodiments, a universal base is a heterocyclic moiety located at the 1' position of a nucleotide sugar moiety in a modified nucleotide, or the equivalent position in a nucleotide sugar moiety substitution, that, when present in a duplex, can be positioned opposite more than one type of base without substantially altering structure of the duplex. In some embodiments, compared to a reference single-stranded nucleic acid (e.g., oligonucleotide) that is fully complementary to a target nucleic acid (e.g., a MARC1 mRNA), a single-stranded nucleic acid containing a universal base forms a duplex with the target nucleic acid that has a lower $T_m$ than a duplex formed with the complementary nucleic acid. In some embodiments, when compared to a reference single-stranded nucleic acid in which the universal base has been replaced with a base to generate a single mismatch, the single-stranded nucleic acid containing the universal base forms a duplex with the target nucleic acid that has a higher $T_m$ than a duplex formed with the nucleic acid comprising the mismatched base.

Non-limiting examples of universal-binding nucleotides include, but are not limited to, inosine, 1-O-D-ribofuranosyl-5-nitroindole and/or 1-O-D-ribofuranosyl-3-nitropyrrole (see, US Patent Application Publication No. 2007/0254362; Van Aerschot et al. (1995) NUCLEIC ACIDS RES. 23:4363-4370; Loakes et al. (1995) NUCLEIC ACIDS RES. 23:2361-66; and Loakes & Brown (1994) NUCLEIC ACIDS RES. 22:4039-43).

Targeting Ligands

In some embodiments, it is desirable to target an oligonucleotide provided herein (e.g., an RNAi oligonucleotide) to one or more cells or cell type, tissues, organs, or anatomical regions or compartments. Such a strategy may help to avoid undesirable effects to the organism treated and/or to avoid undue loss of the oligonucleotide to cells, tissues, organs, or anatomical regions or compartments that would not benefit from the oligonucleotide or its effects (e.g., inhibition or reduction of MARC1 expression). Accordingly, in some embodiments, oligonucleotides disclosed herein (e.g., RNAi oligonucleotides) are modified to facilitate targeting and/or delivery to particular cells or cell types, tissues, organs, or anatomical regions or compartments (e.g., to facilitate delivery of the oligonucleotide to the liver). In some embodiments, an oligonucleotide comprises at least one nucleotide (e.g., 1, 2, 3, 4, 5, 6, or more nucleotides) conjugated to one or more targeting ligand(s). In some embodiments, the sense and antisense strands of an oligonucleotide comprise nucleotides sequences selected from the group consisting of:

(a) SEQ ID NOs: 1537 and 1573, respectively;
(b) SEQ ID NOs: 1538 and 1574, respectively;
(c) SEQ ID NOs: 1539 and 1575, respectively;
(d) SEQ ID NOs: 1540 and 1576, respectively;
(e) SEQ ID NOs: 1541 and 1577, respectively;
(f) SEQ ID NOs: 1542 and 1578, respectively;
(g) SEQ ID NOs: 1543 and 1579, respectively;
(h) SEQ ID NOs: 1544 and 1580, respectively;
(i) SEQ ID NOs: 1545 and 1581, respectively;
(j) SEQ ID NOs: 1546 and 1582, respectively;
(k) SEQ ID NOs: 1547 and 1583, respectively;
(l) SEQ ID NOs: 1548 and 1584, respectively;
(m) SEQ ID NOs: 1549 and 1585, respectively;
(n) SEQ ID NOs: 1550 and 1586, respectively;
(o) SEQ ID NOs: 1551 and 1587, respectively;
(p) SEQ ID NOs: 1552 and 1588, respectively;
(q) SEQ ID NOs: 1553 and 1589, respectively;
(r) SEQ ID NOs: 1554 and 1590, respectively;
(s) SEQ ID NOs: 1555 and 1591, respectively;
(t) SEQ ID NOs: 1556 and 1592, respectively;
(u) SEQ ID NOs: 1557 and 1593, respectively;
(v) SEQ ID NOs: 1558 and 1594, respectively;
(w) SEQ ID NOs: 1559 and 1595, respectively;
(x) SEQ ID NOs: 1560 and 1596, respectively;
(y) SEQ ID NOs: 1561 and 1597, respectively;
(z) SEQ ID NOs: 1562 and 1598, respectively;
(aa) SEQ ID NOs: 1563 and 1599, respectively;
(bb) SEQ ID NOs: 1564 and 1600, respectively;
(cc) SEQ ID NOs: 1565 and 1601, respectively;
(dd) SEQ ID NOs: 1566 and 1602, respectively;
(ee) SEQ ID NOs: 1567 and 1603, respectively;
(ff) SEQ ID NOs: 1568 and 1604, respectively;
(gg) SEQ ID NOs: 1569 and 1605, respectively; and,
(hh) SEQ ID NOs: 1570 and 1606, respectively,
wherein the oligonucleotide comprises a targeting ligand conjugated to at least one nucleotide.

In some embodiments, an oligonucleotide comprises at least one nucleotide (e.g., 1, 2, 3, 4, 5, 6, or more nucleotides) conjugated to one or more targeting ligand(s). In some embodiments, the sense and antisense strands of an oligonucleotide comprise nucleotides sequences selected from the group consisting of:

(a) SEQ ID NOs: 1543 and 1579, respectively;
(b) SEQ ID NOs: 1560 and 1596, respectively;
(c) SEQ ID NOs: 1568 and 1604, respectively; and,
(d) SEQ ID NOs: 1553 and 1589, respectively,
wherein the oligonucleotide comprises a targeting ligand conjugated to at least one nucleotide.

In some embodiments, the targeting ligand comprises a carbohydrate, amino sugar, cholesterol, peptide, polypeptide, protein, or part of a protein (e.g., an antibody or antibody fragment), or lipid. In certain embodiments, the targeting ligand is a carbohydrate comprising at least one GalNAc moiety.

In some embodiments, 1 or more (e.g., 1, 2, 3, 4, 5, or 6) nucleotides of an oligonucleotide provided herein (e.g., an RNAi oligonucleotide) are each conjugated to a separate targeting ligand (e.g., a GalNAc moiety). In some embodiments, 2 to 4 nucleotides of an oligonucleotide are each conjugated to a separate targeting ligand. In some embodiments, targeting ligands are conjugated to 2 to 4 nucleotides at either ends of the sense or antisense strand (e.g., targeting ligands are conjugated to a 2 to 4 nucleotide overhang or extension on the 5' or 3' terminus of the sense or antisense strand) such that the targeting ligands resemble bristles of a toothbrush, and the oligonucleotide resembles a toothbrush. For example, an oligonucleotide may comprise a stem-loop at either the 5' or 3' terminus of the sense strand and 1, 2, 3, or 4 nucleotides of the loop of the stem may be individually conjugated to a targeting ligand. In some embodiments, an oligonucleotide provided by the current invention (e.g., a RNAi oligonucleotide) comprises a stem-loop at the 3' terminus of the sense strand, wherein the loop of the stem-loop comprises a triloop or a tetraloop, and wherein the 3 or 4 nucleotides comprising the triloop or tetraloop, respectively, are individually conjugated to a targeting ligand. In some embodiments, an oligonucleotide provided by the current invention (e.g., a RNAi oligonucleotide) comprises a stem-loop at the 3' terminus of the sense strand, wherein the loop of the stem-loop comprises a tetraloop, and wherein 3 nucleotides of the tetraloop are individually conjugated to a targeting ligand.

GalNAc is a high affinity carbohydrate ligand for the asialoglycoprotein receptor (ASGPR), which is primarily expressed on the surface of hepatocyte cells and has a major role in binding, internalizing and subsequent clearing circulating glycoproteins that contain terminal galactose or GalNAc residues (asialoglycoproteins). Conjugation (either indirect or direct) of GalNAc moieties to oligonucleotides of the instant disclosure can be used to target these oligonucleotides to the ASGPR expressed on cells. In some embodiments, an oligonucleotide of the instant disclosure (e.g., an RNAi oligonucleotide) is conjugated to at least one or more GalNAc moieties, wherein the GalNAc moieties target the oligonucleotide to an ASGPR expressed on human liver cells (e.g., human hepatocytes). In some embodiments, the GalNAc moiety target the oligonucleotide to the liver.

In some embodiments, an oligonucleotide of the instant disclosure (e.g., an RNAi oligonucleotide) is conjugated directly or indirectly to a monovalent GalNAc moiety. In some embodiments, the oligonucleotide is conjugated directly or indirectly to more than one monovalent GalNAc (i.e., is conjugated to 2, 3 or 4 monovalent GalNAc moieties and is typically conjugated to 3 or 4 monovalent GalNAc moieties). In some embodiments, an oligonucleotide is conjugated to one or more bivalent GalNAc, trivalent GalNAc or tetravalent GalNAc moieties. In some embodiments, a bivalent, trivalent or tetravalent GalNAc moiety is conjugated to an oligonucleotide via a branched linker. In some embodiments, a monovalent GalNAc moiety is conjugated to a first nucleotide and a bivalent, trivalent, or tetravalent GalNAc moiety is conjugated to a second nucleotide via a branched linker.

In some embodiments, one (1) or more (e.g., 1, 2, 3, 4, 5, or 6) nucleotides of an oligonucleotide described herein (e.g., an RNAi oligonucleotide) are each conjugated to a GalNAc moiety. In some embodiments, two (2) to four (4) nucleotides of a tetraloop are each conjugated to a separate GalNAc moiety. In some embodiments, one (1) to three (3) nucleotides of a triloop are each conjugated to a separate GalNAc moiety. In some embodiments, targeting ligands are conjugated to two (2) to four (4) nucleotides at either ends of the sense or antisense strand (e.g., ligands are conjugated to a two (2) to four (4) nucleotide overhang or extension on the 5' or 3' terminus of the sense or antisense strand) such that the GalNAc moieties resemble bristles of a toothbrush and the oligonucleotide resembles a toothbrush. In some embodiments, GalNAc moieties are conjugated to a nucleotide of the sense strand. For example, three (3) or four (4) GalNAc moieties can be conjugated to nucleotides in the tetraloop of the sense strand where each GalNAc moiety is conjugated to one (1) nucleotide.

In some embodiments, an oligonucleotide described herein (e.g., an RNAi oligonucleotide) comprises a tetraloop, wherein the tetraloop (L) is any combination of adenine (A) and guanine (G) nucleotides. In some embodiments, the tetraloop (L) comprises a monovalent GalNAc moiety attached to any one or more guanine (G) nucleotides of the tetraloop via any linker described herein, as depicted below (X=heteroatom):

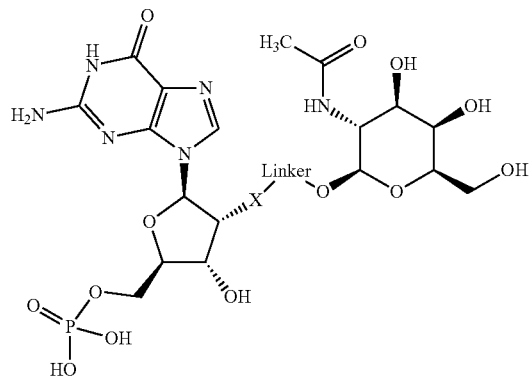

In some embodiments, the tetraloop (L) has a monovalent GalNAc attached to any one or more adenine nucleotides of the tetraloop via any linker described herein, as depicted below (X=heteroatom):

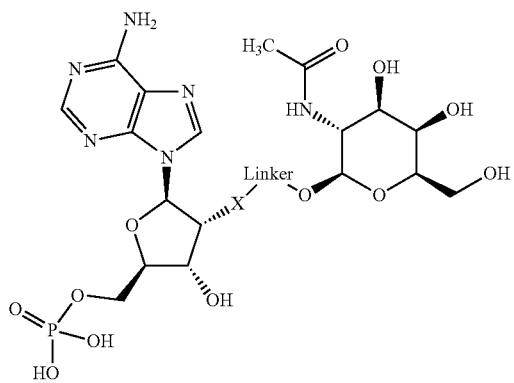

In some embodiments, an oligonucleotide herein (e.g., an RNAi oligonucleotide) comprises a monovalent GalNAc moiety attached to a guanine (G) nucleotide referred to as [ademG-GalNAc] or 2'-aminodiethoxymethanol-Guanine-GalNAc, as depicted below:

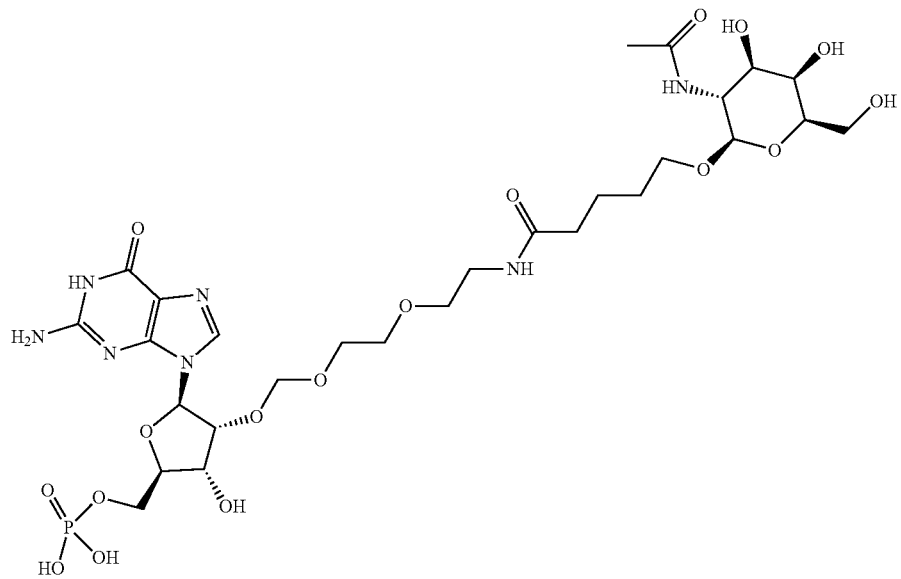 [SMILES: CC(=O)N[C@H]1[C@H](OCCCCC(=O)NCCOCCOCO[C@@H]2[C@H](O)[C@@H](COP(=O)(O)O)O[C@H]2n2cnc3c(=O)[nH]c(N)nc32)O[C@H](CO)[C@H](O)[C@@H]1O]

In some embodiments, an oligonucleotide herein comprises a monovalent GalNAc moiety attached to an adenine nucleotide, referred to as [ademA-GalNAc] or 2'-aminodiethoxymethanol-Adenine-GalNAc, as depicted below:

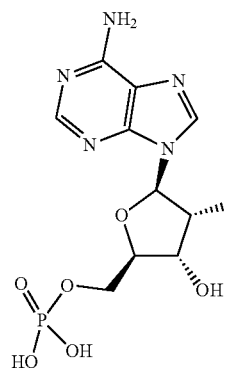

An example of such conjugation is shown below for a loop comprising from 5' to 3' the nucleotide sequence GAAA (L=linker, X=heteroatom). Such a loop may be present, for example, at positions 27-30 of a sense strand provided herein. In the chemical formula, is used to describe an attachment point to the oligonucleotide strand.

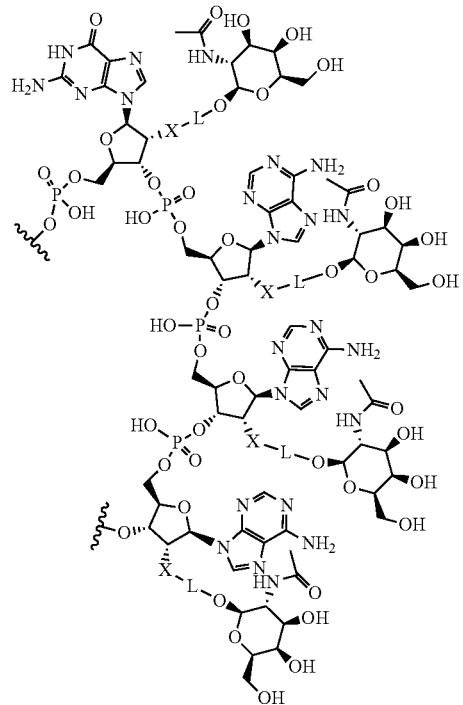

Appropriate methods or chemistry (e.g., click chemistry) can be used to link a targeting ligand to a nucleotide. In some embodiments, a targeting ligand is conjugated to a nucleotide comprising an oligonucleotide herein (e.g., an RNAi oligonucleotide) using a click linker. In some embodiments, an acetal-based linker is used to conjugate a targeting ligand to a nucleotide of any one of the oligonucleotides described herein. Acetal-based linkers are disclosed, for example, in Intl. Patent Application Publication No. WO2016/100401. In some embodiments, the linker is a labile linker. However, in other embodiments, the linker is stable. An example is shown below for a loop comprising from 5' to 3' the nucleotides GAAA, in which GalNAc moieties are attached to nucleotides of the loop using an acetal linker. Such a loop may be present, for example, at positions 27-30 of the any one of the sense strands. In the chemical formula,

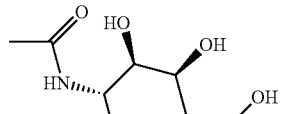

is an attachment point to the oligonucleotide strand.

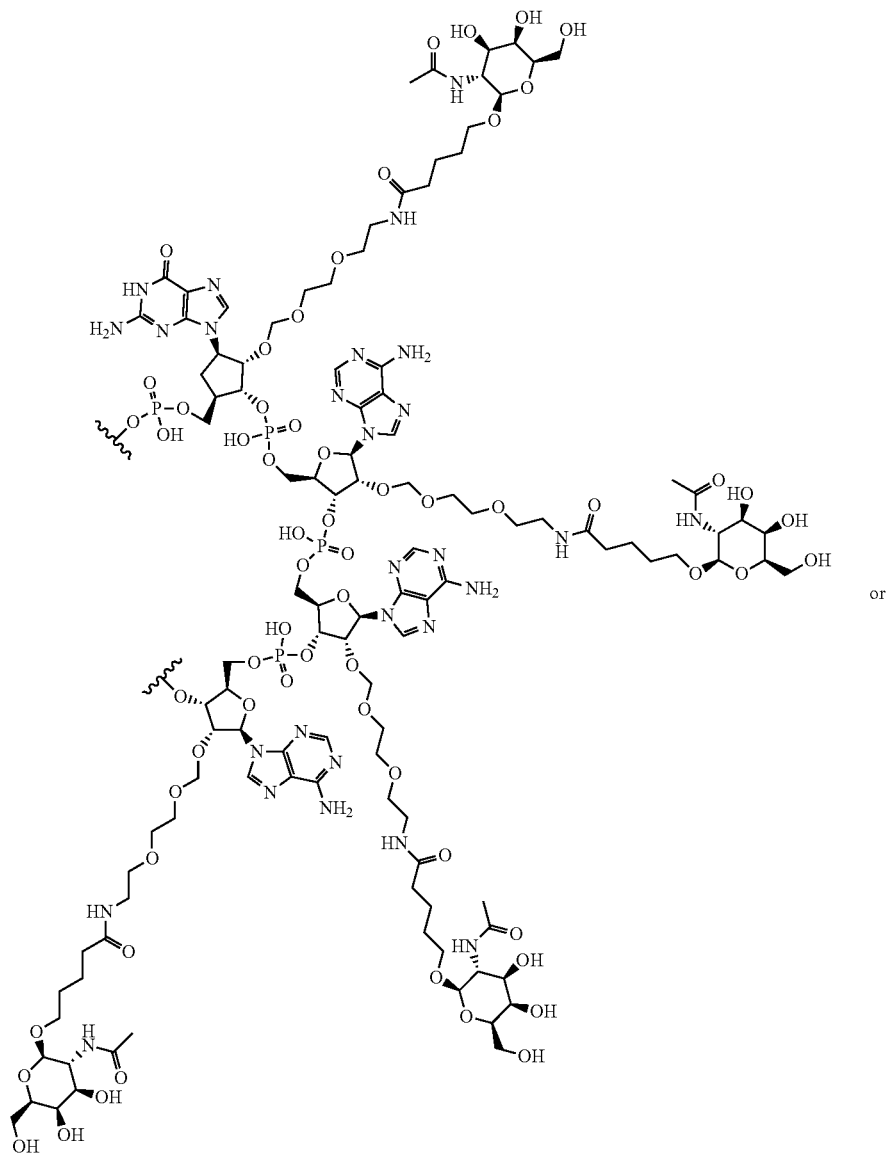 [SMILES: *O[C@H]1[C@@H](OCOCCOCCNC(=O)CCCCO[C@@H]2O[C@H](CO)[C@H](O)[C@H](O)[C@H]2NC(C)=O)[C@H](n2cnc3c(N)ncnc32)O[C@@H]1COP(=O)(O)O[C@H]1[C@@H](OCOCCOCCNC(=O)CCCCO[C@@H]2O[C@H](CO)[C@H](O)[C@H](O)[C@H]2NC(C)=O)[C@H](n2cnc3c(N)ncnc32)O[C@@H]1COP(=O)(O)O[C@H]1[C@@H](OCOCCOCCNC(=O)CCCCO[C@@H]2O[C@H](CO)[C@H](O)[C@H](O)[C@H]2NC(C)=O)[C@H](n2cnc3c(N)ncnc32)O[C@@H]1COP(=O)(O)O[C@@H]1[C@@H](COP(=O)(O)O*)C[C@@H](n2cnc3c(=O)[nH]c(N)nc32)[C@@H]1OCOCCOCCNC(=O)CCCCO[C@@H]1O[C@H](CO)[C@H](O)[C@H](O)[C@H]1NC(C)=O]
or

-continued

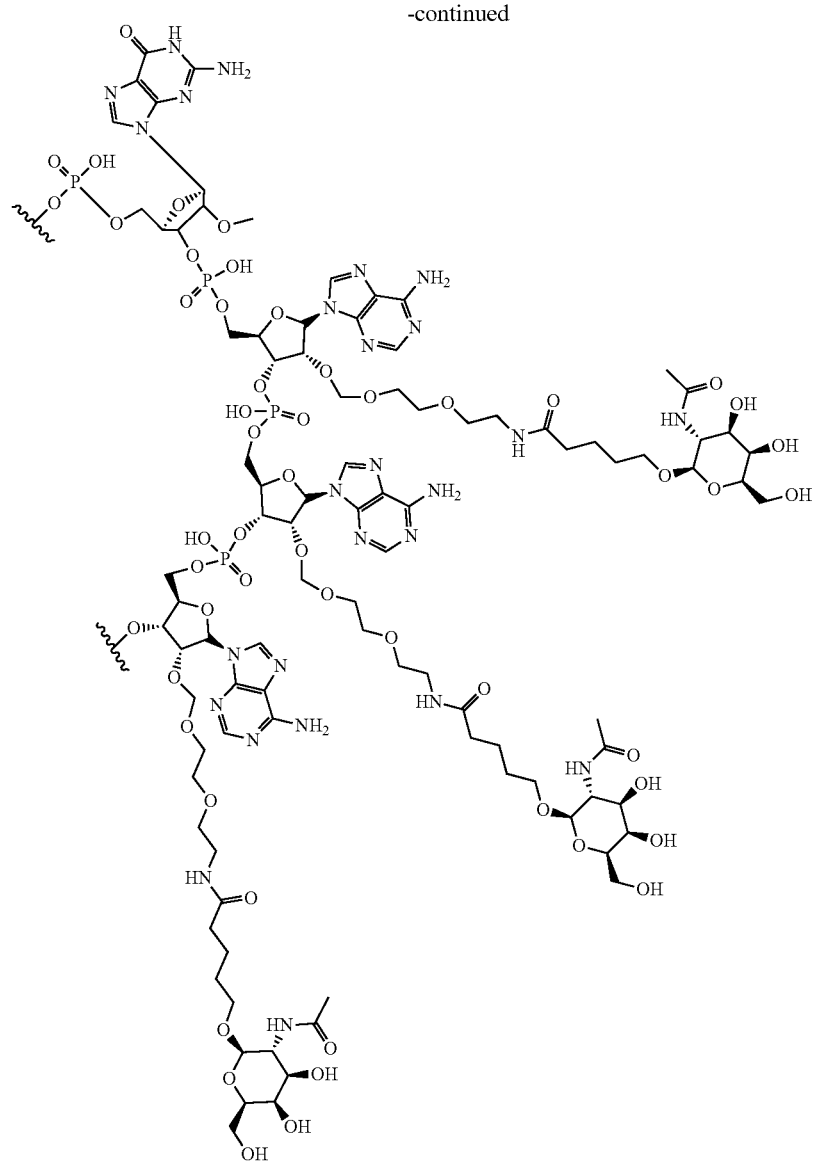

As mentioned, various appropriate methods or chemistry synthetic techniques (e.g., click chemistry) can be used to link a targeting ligand to a nucleotide. In some embodiments, a targeting ligand is conjugated to a nucleotide using a click linker. In some embodiments, an acetal-based linker is used to conjugate a targeting ligand to a nucleotide of any one of the oligonucleotides described herein. Acetal-based linkers are disclosed, for example, in Intl. Patent Application Publication No. WO 2016/100401. In some embodiments, the linker is a labile linker. However, in other embodiments, the linker is a stable linker.

In some embodiments, a duplex extension (e.g., of up to 3, 4, 5, or 6 bp in length) is provided between a targeting ligand (e.g., a GalNAc moiety) and the oligonucleotide. In some embodiments, the oligonucleotides herein (e.g., RNAi oligonucleotides) do not have a GalNAc conjugated thereto.

In some embodiments, the sense and antisense strands of an oligonucleotide comprise nucleotides sequences selected from the group consisting of:

(a) SEQ ID NOs: 1537 and 1573, respectively;
(b) SEQ ID NOs: 1538 and 1574, respectively;
(c) SEQ ID NOs: 1539 and 1575, respectively;
(d) SEQ ID NOs: 1540 and 1576, respectively;
(e) SEQ ID NOs: 1541 and 1577, respectively;
(f) SEQ ID NOs: 1542 and 1578, respectively;
(g) SEQ ID NOs: 1543 and 1579, respectively;
(h) SEQ ID NOs: 1544 and 1580, respectively;
(i) SEQ ID NOs: 1545 and 1581, respectively;
(j) SEQ ID NOs: 1546 and 1582, respectively;
(k) SEQ ID NOs: 1547 and 1583, respectively;
(l) SEQ ID NOs: 1548 and 1584, respectively;
(m) SEQ ID NOs: 1549 and 1585, respectively;
(n) SEQ ID NOs: 1550 and 1586, respectively;
(o) SEQ ID NOs: 1551 and 1587, respectively;
(p) SEQ ID NOs: 1552 and 1588, respectively;
(q) SEQ ID NOs: 1553 and 1589, respectively;
(r) SEQ ID NOs: 1554 and 1590, respectively;
(s) SEQ ID NOs: 1555 and 1591, respectively;
(t) SEQ ID NOs: 1556 and 1592, respectively;

(u) SEQ ID NOs: 1557 and 1593, respectively;
(v) SEQ ID NOs: 1558 and 1594, respectively;
(w) SEQ ID NOs: 1559 and 1595, respectively;
(x) SEQ ID NOs: 1560 and 1596, respectively;
(y) SEQ ID NOs: 1561 and 1597, respectively;
(z) SEQ ID NOs: 1562 and 1598, respectively;
(aa) SEQ ID NOs: 1563 and 1599, respectively;
(bb) SEQ ID NOs: 1564 and 1600, respectively;
(cc) SEQ ID NOs: 1565 and 1601, respectively;
(dd) SEQ ID NOs: 1566 and 1602, respectively;
(ee) SEQ ID NOs: 1567 and 1603, respectively;
(ff) SEQ ID NOs: 1568 and 1604, respectively;
(gg) SEQ ID NOs: 1569 and 1605, respectively; and,
(hh) SEQ ID NOs: 1570 and 1606, respectively,
wherein the oligonucleotide comprises at least one GalNAc moiety conjugated to a nucleotide.

In some embodiments, the sense and antisense strands of an oligonucleotide comprise nucleotides sequences selected from the group consisting of:
(a) SEQ ID NOs: 1543 and 1579, respectively;
(b) SEQ ID NOs: 1560 and 1596, respectively;
(c) SEQ ID NOs: 1568 and 1604, respectively; and,
(d) SEQ ID NOs: 1553 and 1589, respectively,
wherein the oligonucleotide comprises at least one GalNAc moiety conjugated to a nucleotide.

Exemplary Oligonucleotides for Reducing MARC1 Expression

In some embodiments, the MARC1-targeting dsRNAi oligonucleotide for reducing MARC1 expression provided by the current invention comprise a sense strand and an antisense strand, wherein all nucleotides comprising the sense strand and antisense strand are modified, wherein the antisense strand comprises a region of complementarity to a MARC1 mRNA target sequence of any one of SEQ ID NOs: 1-384, and wherein the region of complementarity is at least 15 contiguous nucleotides in length. In some embodiments, the 5'-terminal nucleotide of the antisense strand comprises 5'-methoxyphosphonate-4'-oxy-2'-O-methyluridine [MePhosphonate-4O-mU], as described herein. In some embodiments, the 5'-terminal nucleotide of the antisense strand comprises a phosphorothioate linkage. In some embodiments, the antisense strand and the sense strand comprise one or more 2'-fluoro (2'-F) and 2'-O-methyl (2'-OMe) modified nucleotides and at least one phosphorothioate linkage. In some embodiments, the antisense strand comprises four (4) phosphorothioate linkages and the sense strand comprises one (1) phosphorothioate linkage. In some embodiments, the antisense strand comprises five (5) phosphorothioate linkages and the sense strand comprises one (1) phosphorothioate linkage.

In some embodiments, an oligonucleotide provided herein (e.g., an RNAi oligonucleotide) comprises a sense strand having a sequence of any one of SEQ ID NOs: 769-1152 and an antisense strand comprising a complementary sequence selected from SEQ ID NOs: 1153-1536.

In some embodiments, an oligonucleotide provided herein (e.g., an RNAi oligonucleotide) comprises a sense strand having a sequence of any one of SEQ ID NOs: 1537-1570 and an antisense strand comprising a complementary sequence selected from SEQ ID NOs: 1573-1606.

In some embodiments, an oligonucleotide provided herein (e.g., an RNAi oligonucleotide) comprises a sense strand having a sequence of any one of SEQ ID NOs: 1609-1642 and an antisense strand comprising a complementary sequence selected from SEQ ID NOs: 1645-1678.

In some embodiments, an oligonucleotide provided herein (e.g., and RNAi oligonucleotide) for reducing MARC1 expression comprises:
a sense strand comprising a 2'-F modified nucleotide at positions 8-11, a 2'-OMe modified nucleotide at positions 1-7, 12-27, and 31-36, a GalNAc-conjugated nucleotide at position 28, 29, and 30; and a phosphorothioate linkage between positions 1 and 2;
an antisense strand comprising a 2'-F modified nucleotide at positions 2, 3, 4, 5, 7, 10 and 14, a 2'-OMe at positions 1, 6, 8, 9, 11-13, and 15-22, a phosphorothioate linkage between positions 1 and 2, positions 2 and 3, positions 3 and 4, positions 20 and 21, and positions 21 and 22, and a 5'-terminal nucleotide at position 1 comprising a 4'-phosphate analog, optionally wherein the 5'-terminal nucleotide comprises 5'-methoxyphosphonate-4'-oxy-2'-O-methyluridine [MePhosphonate-4O-mU]; wherein positions 1-20 of the antisense strand form a duplex region with positions 1-20 of the sense strand, wherein positions 21-36 of the sense strand form a stem-loop, wherein positions 27-30 form the loop of the stem-loop, optionally wherein positions 27-30 comprise a tetraloop, wherein positions 21 and 22 of the antisense strand comprise an overhang, and wherein the sense strand and antisense strands comprise nucleotide sequences selected from the group consisting of:
(a) SEQ ID NOs: 1537 and 1573, respectively;
(b) SEQ ID NOs: 1538 and 1574, respectively;
(c) SEQ ID NOs: 1539 and 1575, respectively;
(d) SEQ ID NOs: 1540 and 1576, respectively;
(e) SEQ ID NOs: 1541 and 1577, respectively;
(f) SEQ ID NOs: 1542 and 1578, respectively;
(g) SEQ ID NOs: 1543 and 1579, respectively;
(h) SEQ ID NOs: 1544 and 1580, respectively;
(i) SEQ ID NOs: 1545 and 1581, respectively;
(j) SEQ ID NOs: 1546 and 1582, respectively;
(k) SEQ ID NOs: 1547 and 1583, respectively;
(l) SEQ ID NOs: 1548 and 1584, respectively;
(m) SEQ ID NOs: 1549 and 1585, respectively;
(n) SEQ ID NOs: 1550 and 1586, respectively;
(o) SEQ ID NOs: 1551 and 1587, respectively;
(p) SEQ ID NOs: 1552 and 1588, respectively;
(q) SEQ ID NOs: 1553 and 1589, respectively;
(r) SEQ ID NOs: 1554 and 1590, respectively;
(s) SEQ ID NOs: 1555 and 1591, respectively;
(t) SEQ ID NOs: 1556 and 1592, respectively;
(u) SEQ ID NOs: 1557 and 1593, respectively;
(v) SEQ ID NOs: 1558 and 1594, respectively;
(w) SEQ ID NOs: 1559 and 1595, respectively;
(x) SEQ ID NOs: 1560 and 1596, respectively;
(y) SEQ ID NOs: 1561 and 1597, respectively;
(z) SEQ ID NOs: 1562 and 1598, respectively;
(aa) SEQ ID NOs: 1563 and 1599, respectively;
(bb) SEQ ID NOs: 1564 and 1600, respectively;
(cc) SEQ ID NOs: 1565 and 1601, respectively;
(dd) SEQ ID NOs: 1566 and 1602, respectively;
(ee) SEQ ID NOs: 1567 and 1603, respectively;
(ff) SEQ ID NOs: 1568 and 1604, respectively;
(gg) SEQ ID NOs: 1569 and 1605, respectively; and,
(hh) SEQ ID NOs: 1570 and 1606, respectively, In some embodiments, the MARC1-targeting dsRNAi oligonucleotides for reducing MARC1 expression comprise:
a sense strand comprising a 2'-F modified nucleotide at positions 8-11, a 2'-OMe modified nucleotide at positions 1-7, 12-27, and 31-36, a GalNAc-conjugated nucleotide at position 28, 29 and 30; and a phosphorothioate linkage between positions 1 and 2;

an antisense strand comprising a 2'-F modified nucleotide at positions 2, 3, 4, 5, 7, 10, and 14, a 2'-OMe at positions 1, 6, 8, 9, 11-13, and 15-22, a phosphorothioate linkage between positions 1 and 2, positions 2 and 3, positions 3 and 4, positions 20 and 21, and positions 21 and 22, and a 5'-terminal nucleotide at position 1 comprising a 4'-phosphate analog, optionally wherein the 5'-terminal nucleotide comprises 5'-methoxyphosphonate-4'-oxy-2'-O-methyluridine [MePhosphonate-40-mU]; wherein positions 1-20 of the antisense strand form a duplex region with positions 1-20 of the sense strand, wherein positions 21-36 of the sense strand form a stem-loop, wherein positions 27-30 form the loop of the stem-loop, optionally wherein positions 27-30 comprise a tetraloop, wherein positions 21 and 22 of the antisense strand comprise an overhang, and wherein the sense strand and antisense strands comprise nucleotide sequences selected from the group consisting of:

(a) SEQ ID NOs: 1543 and 1579, respectively;
(b) SEQ ID NOs: 1560 and 1596, respectively;
(c) SEQ ID NOs: 1568 and 1604, respectively; and,
(d) SEQ ID NOs: 1553 and 1589, respectively.

In some embodiments, a MARC1-targeting oligonucleotide for reducing MARC1 expression provided by the current invention comprises a sense strand comprising the nucleotide sequence as set forth in SEQ ID NO: 1543 and an antisense strand comprising the nucleotide sequence as set forth in SEQ ID NO: 1579. In some embodiments, a MARC1-targeting oligonucleotide for reducing MARC1 expression provided by the current invention comprises a sense strand comprising the nucleotide sequence as set forth in SEQ ID NO: 1560 and an antisense strand comprising the nucleotide sequence as set forth in SEQ ID NO: 1596. In some embodiments, a MARC1-targeting oligonucleotide for reducing MARC1 expression provided by the current invention comprises a sense strand comprising the nucleotide sequence as set forth in SEQ ID NO: 1568 and an antisense strand comprising the nucleotide sequence as set forth in SEQ ID NO: 1604. In some embodiments, a MARC1-targeting oligonucleotide for reducing MARC1 expression provided by the current invention comprises a sense strand comprising the nucleotide sequence as set forth in SEQ ID NO: 1553 and an antisense strand comprising the nucleotide sequence as set forth in SEQ ID NO: 1589.

In some embodiments, a MARC1-targeting dsRNAi oligonucleotide for reducing MARC1 expression comprises (i) an antisense strand of 19-30 nucleotides in length, wherein the antisense strand comprises a nucleotide sequence comprising a region of complementarity to a MARC1 mRNA target sequence, wherein the region of complementarity is set forth in SEQ ID NO: 618; and (ii) a sense strand of 19-50 nucleotides in length comprising a region of complementarity to the antisense strand, wherein the antisense and sense strands are separate strands which form an asymmetric duplex region having an overhang of 1-4 nucleotides at the 3' terminus of the antisense strand.

In some embodiments, a MARC1-targeting dsRNAi oligonucleotide for reducing MARC1 expression comprises (i) an antisense strand of 19-30 nucleotides in length, wherein the antisense strand comprises a nucleotide sequence comprising a region of complementarity to a MARC1 mRNA target sequence, wherein the region of complementarity is set forth in SEQ ID NO: 682; and (ii) a sense strand of 19-50 nucleotides in length comprising a region of complementarity to the antisense strand, wherein the antisense and sense strands are separate strands which form an asymmetric duplex region having an overhang of 1-4 nucleotides at the 3' terminus of the antisense strand.

In some embodiments, a MARC1-targeting dsRNAi oligonucleotide for reducing MARC1 expression comprises (i) an antisense strand of 19-30 nucleotides in length, wherein the antisense strand comprises a nucleotide sequence comprising a region of complementarity to a MARC1 mRNA target sequence, wherein the region of complementarity is set forth in SEQ ID NO: 740; and (ii) a sense strand of 19-50 nucleotides in length comprising a region of complementarity to the antisense strand, wherein the antisense and sense strands are separate strands which form an asymmetric duplex region having an overhang of 1-4 nucleotides at the 3' terminus of the antisense strand.

In some embodiments, a MARC1-targeting dsRNAi oligonucleotide for reducing MARC1 expression comprises (i) an antisense strand of 19-30 nucleotides in length, wherein the antisense strand comprises a nucleotide sequence comprising a region of complementarity to a MARC1 mRNA target sequence, wherein the region of complementarity is set forth in SEQ ID NO: 760; and (ii) a sense strand of 19-50 nucleotides in length comprising a region of complementarity to the antisense strand, wherein the antisense and sense strands are separate strands which form an asymmetric duplex region having an overhang of 1-4 nucleotides at the 3' terminus of the antisense strand.

In some embodiments, a MARC1-targeting dsRNAi oligonucleotide for reducing MARC1 expression comprises (i) an antisense strand of 19-30 nucleotides in length, wherein the antisense strand comprises a nucleotide sequence comprising a region of complementarity to a MARC1 mRNA target sequence, wherein the region of complementarity is set forth in SEQ ID NO: 618; and (ii) a sense strand of 19-50 nucleotides in length comprising a region of complementarity to the antisense strand and a stem-loop at the 3' terminus, wherein the stem-loop is set forth as S1-L-S2, wherein 51 is complementary to S2 and wherein L forms a loop between S1 and S2 of 3 to 5 nucleotides in length, wherein the antisense and sense strands are separate strands which form an asymmetric duplex region having an overhang of 1-4 nucleotides at the 3' terminus of the antisense strand.

In some embodiments, a MARC1-targeting dsRNAi oligonucleotide for reducing MARC1 expression comprises (i) an antisense strand of 19-30 nucleotides in length, wherein the antisense strand comprises a nucleotide sequence comprising a region of complementarity to a MARC1 mRNA target sequence, wherein the region of complementarity is set forth in SEQ ID NO: 682; and (ii) a sense strand of 19-50 nucleotides in length comprising a region of complementarity to the antisense strand and a stem-loop at the 3' terminus, wherein the stem-loop is set forth as S1-L-S2, wherein 51 is complementary to S2 and wherein L forms a loop between S1 and S2 of 3 to 5 nucleotides in length, wherein the antisense and sense strands are separate strands which form an asymmetric duplex region having an overhang of 1-4 nucleotides at the 3' terminus of the antisense strand.

In some embodiments, a MARC1-targeting dsRNAi oligonucleotide for reducing MARC1 expression comprises (i) an antisense strand of 19-30 nucleotides in length, wherein the antisense strand comprises a nucleotide sequence comprising a region of complementarity to a MARC1 mRNA target sequence, wherein the region of complementarity is set forth in SEQ ID NO: 740; and (ii) a sense strand of 19-50 nucleotides in length comprising a region of complementarity to the antisense strand and a stem-loop at the 3' terminus, wherein the stem-loop is set forth as S1-L-S2, wherein 51 is complementary to S2 and wherein L forms a loop between S1 and S2 of 3 to 5 nucleotides in length, wherein the antisense and sense strands are separate strands which form an asymmetric duplex region having an overhang of 1-4 nucleotides at the 3' terminus of the antisense strand.

In some embodiments, a MARC1-targeting dsRNAi oligonucleotide for reducing MARC1 expression comprises (i) an antisense strand of 19-30 nucleotides in length, wherein the antisense strand comprises a nucleotide sequence comprising a region of complementarity to a MARC1 mRNA target sequence, wherein the region of complementarity is set forth in SEQ ID NO: 760; and (ii) a sense strand of 19-50 nucleotides in length comprising a region of complementarity to the antisense strand and a stem-loop at the 3' terminus, wherein the stem-loop is set forth as S1-L-S2, wherein 51 is complementary to S2 and wherein L forms a loop between S1 and S2 of 3 to 5 nucleotides in length, wherein the antisense and sense strands are separate strands which form an asymmetric duplex region having an overhang of 1-4 nucleotides at the 3' terminus of the antisense strand.

In some embodiments, a MARC1-targeting dsRNAi oligonucleotide for reducing MARC1 expression comprises (i) an antisense strand of 19-30 nucleotides in length, wherein the antisense strand comprises a nucleotide sequence comprising a region of complementarity to a MARC1 mRNA target sequence, wherein the region of complementarity is set forth in SEQ ID NO: 618; and (ii) a sense strand of 19-50 nucleotides in length comprising a region of complementarity to the antisense strand, wherein the region of complementarity to the antisense strand is set forth in SEQ ID NO: 234, wherein the antisense and sense strands are separate strands which form an asymmetric duplex region having an overhang of 1-4 nucleotides at the 3' terminus of the antisense strand.

In some embodiments, a MARC1-targeting dsRNAi oligonucleotide for reducing MARC1 expression comprises (i) an antisense strand of 19-30 nucleotides in length, wherein the antisense strand comprises a nucleotide sequence comprising a region of complementarity to a MARC1 mRNA target sequence, wherein the region of complementarity is set forth in SEQ ID NO: 682; and (ii) a sense strand of 19-50 nucleotides in length comprising a region of complementarity to the antisense strand, wherein the region of complementarity to the antisense strand is set forth in SEQ ID NO: 298, wherein the antisense and sense strands are separate strands which form an asymmetric duplex region having an overhang of 1-4 nucleotides at the 3' terminus of the antisense strand.

In some embodiments, a MARC1-targeting dsRNAi oligonucleotide for reducing MARC1 expression comprises (i) an antisense strand of 19-30 nucleotides in length, wherein the antisense strand comprises a nucleotide sequence comprising a region of complementarity to a MARC1 mRNA target sequence, wherein the region of complementarity is set forth in SEQ ID NO: 740; and (ii) a sense strand of 19-50 nucleotides in length comprising a region of complementarity to the antisense strand, wherein the region of complementarity to the antisense strand is set forth in SEQ ID NO: 356, wherein the antisense and sense strands are separate strands which form an asymmetric duplex region having an overhang of 1-4 nucleotides at the 3' terminus of the antisense strand.

In some embodiments, a MARC1-targeting dsRNAi oligonucleotide for reducing MARC1 expression comprises (i) an antisense strand of 19-30 nucleotides in length, wherein the antisense strand comprises a nucleotide sequence comprising a region of complementarity to a MARC1 mRNA target sequence, wherein the region of complementarity is set forth in SEQ ID NO: 760; and (ii) a sense strand of 19-50 nucleotides in length comprising a region of complementarity to the antisense strand, wherein the region of complementarity to the antisense strand is set forth in SEQ ID NO: 376, wherein the antisense and sense strands are separate strands which form an asymmetric duplex region having an overhang of 1-4 nucleotides at the 3' terminus of the antisense strand.

In some embodiments, a MARC1-targeting dsRNAi oligonucleotide for reducing MARC1 expression comprises (i) an antisense strand of 19-30 nucleotides in length, wherein the antisense strand comprises a nucleotide sequence comprising a region of complementarity to a MARC1 mRNA target sequence, wherein the region of complementarity is set forth in SEQ ID NO: 618; and (ii) a sense strand of 19-50 nucleotides in length comprising a region of complementarity to the antisense strand and a stem-loop at the 3' terminus, wherein the region of complementarity to the antisense strand is set forth in SEQ ID NO: 234, wherein the stem-loop is set forth as S1-L-S2, wherein 51 is complementary to S2 and wherein L forms a loop between S1 and S2 of 3 to 5 nucleotides in length, wherein the antisense and sense strands are separate strands which form an asymmetric duplex region having an overhang of 1-4 nucleotides at the 3' terminus of the antisense strand.

In some embodiments, a MARC1-targeting dsRNAi oligonucleotide for reducing MARC1 expression comprises (i) an antisense strand of 19-30 nucleotides in length, wherein the antisense strand comprises a nucleotide sequence comprising a region of complementarity to a MARC1 mRNA target sequence, wherein the region of complementarity is set forth in SEQ ID NO: 682; and (ii) a sense strand of 19-50 nucleotides in length comprising a region of complementarity to the antisense strand and a stem-loop at the 3' terminus, wherein the region of complementarity to the antisense strand is set forth in SEQ ID NO: 298, wherein the stem-loop is set forth as S1-L-S2, wherein 51 is complementary to S2 and wherein L forms a loop between S1 and S2 of 3 to 5 nucleotides in length, wherein the antisense and sense strands are separate strands which form an asymmetric duplex region having an overhang of 1-4 nucleotides at the 3' terminus of the antisense strand.

In some embodiments, a MARC1-targeting dsRNAi oligonucleotide for reducing MARC1 expression comprises (i) an antisense strand of 19-30 nucleotides in length, wherein the antisense strand comprises a nucleotide sequence comprising a region of complementarity to a MARC1 mRNA target sequence, wherein the region of complementarity is set forth in SEQ ID NO: 740; and (ii) a sense strand of 19-50 nucleotides in length comprising a region of complementarity to the antisense strand and a stem-loop at the 3' terminus, wherein the region of complementarity to the antisense strand is set forth in SEQ ID NO: 356, wherein the stem-loop is set forth as S1-L-S2, wherein 51 is complementary to S2 and wherein L forms a loop between S1 and S2 of 3 to 5 nucleotides in length, wherein the antisense and sense strands are separate strands which form an asymmetric duplex region having an overhang of 1-4 nucleotides at the 3' terminus of the antisense strand.

In some embodiments, a MARC1-targeting dsRNAi oligonucleotide for reducing MARC1 expression comprises (i) an antisense strand of 19-30 nucleotides in length, wherein the antisense strand comprises a nucleotide sequence comprising a region of complementarity to a MARC1 mRNA target sequence, wherein the region of complementarity is set forth in SEQ ID NO: 760; and (ii) a sense strand of 19-50 nucleotides in length comprising a region of complementarity to the antisense strand and a stem-loop at the 3' terminus, wherein the region of complementarity to the antisense strand is set forth in SEQ ID NO: 376, wherein the stem-loop is set forth as S1-L-S2, wherein 51 is complementary to S2 and wherein L forms a loop between S1 and S2 of 3 to 5 nucleotides in length, wherein the antisense and sense strands are separate strands which form an asymmetric duplex region having an overhang of 1-4 nucleotides at the 3' terminus of the antisense strand.

In some embodiments, the current invention provides an oligonucleotide (e.g., an RNAi oligonucleotide) for reducing MARC1 expression, wherein the oligonucleotide comprises a sense strand and an antisense strand according to:

```
Sense Strand:
5'-mX-S-mX-mX-mX-mX-mX-mX-fX-fX-fX-fX-mX-mX-mXmX-mX-mX-mX-mX-mX-mX-mX-mX-mX-mX-mX-

[ademA-GalNAc]-[ademA-GalNAc]-[ademA-GalNAc]- mX-mX-mX-mX-mX-mX-3';

hybridized to:
Antisense Strand:
5'-[MePhosphonate-4O-mX]-S-fX-S-fX-S-fX-fX-mXfX-mX-mX-fX-mX-mX-mX-fX-mX-mX-mX-mX-mX-mX-S- mX-S-mX-3';
``` wherein mX=2'-O-methyl modified nucleotide, fX=2'-fluoro modified nucleotide, —S—=phosphorothioate linkage, –=phosphodiester linkage, [MePhosphonate-4O-mX]=5'-methoxyphosphonate-4-oxy modified nucleotide, and ademA-GalNAc=GalNAc attached to an adenine nucleotide.

In some embodiments, the current invention provides an oligonucleotide (e.g., an RNAi oligonucleotide) for reducing MARC1 expression, wherein the oligonucleotide comprises a sense strand and an antisense strand comprising nucleotide sequences selected from the group consisting of:
(a) SEQ ID NOs: 1609 and 1645, respectively;
(b) SEQ ID NOs: 1610 and 1646, respectively;
(c) SEQ ID NOs: 1611 and 1647, respectively;
(d) SEQ ID NOs: 1612 and 1648, respectively;
(e) SEQ ID NOs: 1613 and 1649, respectively;
(f) SEQ ID NOs: 1614 and 1650, respectively;
(g) SEQ ID NOs: 1615 and 1651, respectively;
(h) SEQ ID NOs: 1616 and 1652, respectively;
(i) SEQ ID NOs: 1617 and 1653, respectively;
(j) SEQ ID NOs: 1618 and 1654, respectively;
(k) SEQ ID NOs: 1619 and 1655, respectively;
(l) SEQ ID NOs: 1620 and 1656, respectively;
(m) SEQ ID NOs: 1621 and 1657, respectively;
(n) SEQ ID NOs: 1622 and 1658, respectively;
(o) SEQ ID NOs: 1623 and 1659, respectively;
(p) SEQ ID NOs: 1624 and 1660, respectively;
(q) SEQ ID NOs: 1625 and 1661, respectively;
(r) SEQ ID NOs: 1626 and 1662, respectively;
(s) SEQ ID NOs: 1627 and 1663, respectively;
(t) SEQ ID NOs: 1628 and 1664, respectively;
(u) SEQ ID NOs: 1628 and 1665, respectively;
(v) SEQ ID NOs: 1630 and 1666, respectively;
(w) SEQ ID NOs: 1631 and 1667, respectively;
(x) SEQ ID NOs: 1632 and 1668, respectively;
(y) SEQ ID NOs: 1633 and 1669, respectively;
(z) SEQ ID NOs: 1634 and 1670, respectively;
(aa) SEQ ID NOs: 1635 and 1671, respectively;
(bb) SEQ ID NOs: 1636 and 1672, respectively;
(cc) SEQ ID NOs: 1637 and 1673, respectively;
(dd) SEQ ID NOs: 1638 and 1674, respectively;
(ee) SEQ ID NOs: 1639 and 1675, respectively;
(ff) SEQ ID NOs: 1640 and 1676, respectively;
(gg) SEQ ID NOs: 1641 and 1677, respectively; and,
(hh) SEQ ID NOs: 1642 and 1678, respectively, In some embodiments, a MARC1-targeting oligonucleotide for reducing MARC1 expression provided by the current invention comprises a sense strand comprising the nucleotide sequence as set forth in SEQ ID NO: 1615 and an antisense strand comprising the nucleotide sequence as set forth in SEQ ID NO: 1651. In some embodiments, a MARC1-targeting oligonucleotide for reducing MARC1 expression provided by the current invention comprises a sense strand comprising the nucleotide sequence as set forth in SEQ ID NO: 1632 and an antisense strand comprising the nucleotide sequence as set forth in SEQ ID NO: 1668. In some embodiments, a MARC1-targeting oligonucleotide for reducing MARC1 expression provided by the current invention comprises a sense strand comprising the nucleotide sequence as set forth in SEQ ID NO: 1640 and an antisense strand comprising the nucleotide sequence as set forth in SEQ ID NO: 1676. In some embodiments, a MARC1-targeting oligonucleotide for reducing MARC1 expression provided by the current invention comprises a sense strand comprising the nucleotide sequence as set forth in SEQ ID NO: 1625 and an antisense strand comprising the nucleotide sequence as set forth in SEQ ID NO: 1661.

Formulations

Various formulations (e.g., pharmaceutical formulations) have been developed for oligonucleotide use. For example, oligonucleotides (e.g., RNAi oligonucleotides) can be delivered to a subject or a cellular environment using a formulation that minimizes degradation, facilitates delivery and/or uptake, or provides another beneficial property to the oligonucleotides in the formulation. In some embodiments, provided herein are compositions comprising oligonucleotides (e.g., RNAi oligonucleotides) reduce the expression of MARC1. Such compositions can be suitably formulated such that when administered to a subject, either into the immediate environment of a target cell or systemically, a sufficient portion of the oligonucleotides enter the cell to reduce MARC1 expression. Any variety of suitable oligonucleotide formulations can be used to deliver oligonucleotides for the reduction of MARC1 as disclosed herein. In some embodiments, an oligonucleotide is formulated in buffer solutions such as PBS solutions, liposomes, micellar structures, and capsids. Any of the oligonucleotides described herein may be provided not only as nucleic acids, but also in the form of a pharmaceutically acceptable salt.

Formulations of oligonucleotides with cationic lipids can be used to facilitate transfection of the oligonucleotides into cells. For example, cationic lipids, such as lipofectin, cationic glycerol derivatives, and polycationic molecules (e.g., polylysine), can be used. Suitable lipids include Oligofectamine, Lipofectamine (Life Technologies), NC388 (Ribozyme Pharmaceuticals, Inc., Boulder, Colo.), or FuGene 6 (Roche) all of which can be used according to the manufacturer's instructions.

Accordingly, in some embodiments, a formulation comprises a lipid nanoparticle. In some embodiments, an excipient comprises a liposome, a lipid, a lipid complex, a microsphere, a microparticle, a nanosphere or a nanoparticle, or may be otherwise formulated for administration to the cells, tissues, organs, or body of a subject in need thereof (see, e.g., Remington: THE SCIENCE AND PRACTICE OF PHARMACY, 22nd edition, Pharmaceutical Press, 2013).

In some embodiments, the formulations herein comprise an excipient. In some embodiments, an excipient confers to a composition improved stability, improved absorption, improved solubility and/or therapeutic enhancement of the active ingredient. In some embodiments, an excipient is a buffering agent (e.g., sodium citrate, sodium phosphate, a tris base, or sodium hydroxide) or a vehicle (e.g., a buffered solution, petrolatum, dimethyl sulfoxide, or mineral oil). In some embodiments, an oligonucleotide is lyophilized for extending its shelf-life and then made into a solution before use (e.g., administration to a subject). Accordingly, an excipient in a composition comprising any one of the oligonucleotides described herein may be a lyoprotectant (e.g., mannitol, lactose, polyethylene glycol or polyvinylpyrrolidone) or a collapse temperature modifier (e.g., dextran, Ficoll™ or gelatin).

In some embodiments, a pharmaceutical composition is formulated to be compatible with its intended route of administration. Examples of routes of administration include parenteral (e.g., intravenous, intramuscular, intraperitoneal, intradermal, subcutaneous), oral (e.g., inhalation), transdermal (e.g., topical), transmucosal and rectal administration.

Pharmaceutical compositions suitable for injectable use include sterile aqueous solutions (where water soluble) or dispersions and sterile powders for the extemporaneous preparation of sterile injectable solutions or dispersions. For intravenous administration, suitable carriers include physiological saline, bacteriostatic water, Cremophor EL™ (BASF, Parsippany, N.J.) or PBS. The carrier can be a solvent or dispersion medium containing, for example, water, ethanol, polyol (e.g., glycerol, propylene glycol, and liquid polyethylene glycol, and the like), and suitable mixtures thereof. In many cases, it will be preferable to include isotonic agents, for example, sugars, polyalcohols such as mannitol, sorbitol, sodium chloride in the composition. Sterile injectable solutions can be prepared by incorporating the oligonucleotides in a required amount in a selected solvent with one or a combination of ingredients enumerated above, as required, followed by filtered sterilization.

In some embodiments, a composition may contain at least about 0.1% of the therapeutic agent (e.g., a RNAi oligonucleotide for reducing MARC1 expression) or more, although the percentage of the active ingredient(s) may be between about 1% to about 80% or more of the weight or volume of the total composition. Factors such as solubility, bioavailability, biological half-life, route of administration, product shelf life, as well as other pharmacological considerations will be contemplated by one skilled in the art of preparing such pharmaceutical formulations, and as such, a variety of dosages and treatment regimens may be desirable.

Methods of Use

Reducing MARC1 Expression

In some embodiments, the current invention provides methods for contacting or delivering to a cell or population of cells an effective amount of oligonucleotides provided herein (e.g., RNAi oligonucleotides) to reduce MARC1 expression. In some embodiments, a reduction of MARC1 expression is determined by measuring a reduction in the amount or level of MARC1 mRNA, MARC1 protein, or MARC1 activity in a cell. The methods include those described herein and known to one of ordinary skill in the art.

Methods provided herein are useful in any appropriate cell type. In some embodiments, a cell is any cell that expresses MARC1 mRNA (e.g., hepatocytes). In some embodiments, the cell is a primary cell obtained from a subject. In some embodiments, the primary cell has undergone a limited number of passages such that the cell substantially maintains its natural phenotypic properties. In some embodiments, a cell to which the oligonucleotide is delivered is ex vivo or in vitro (i.e., can be delivered to a cell in culture or to an organism in which the cell resides).

In some embodiments, the oligonucleotides herein (e.g., RNAi oligonucleotides) are delivered to a cell or population of cells using a nucleic acid delivery method known in the art including, but not limited to, injection of a solution containing the oligonucleotides, bombardment by particles covered by the oligonucleotides, exposing the cell or population of cells to a solution containing the oligonucleotides, or electroporation of cell membranes in the presence of the oligonucleotides. Other methods known in the art for delivering oligonucleotides to cells may be used, such as lipid-mediated carrier transport, chemical-mediated transport, and cationic liposome transfection such as calcium phosphate, and others.

In some embodiments, reduction of MARC1 expression is determined by an assay or technique that evaluates one or more molecules, properties, or characteristics of a cell or population of cells associated with MARC1 expression, or by an assay or technique that evaluates molecules that are directly indicative of MARC1 expression in a cell or population of cells (e.g., MARC1 mRNA or MARC1 protein). In some embodiments, the extent to which an oligonucleotide provided herein reduces MARC1 expression is evaluated by comparing MARC1 expression in a cell or population of cells contacted with the oligonucleotide to an appropriate control (e.g., an appropriate cell or population of cells not contacted with the oligonucleotide or contacted with a control oligonucleotide). In some embodiments, a control amount or level of MARC1 expression in a control cell or population of cells is predetermined, such that the control amount or level need not be measured in every instance the assay or technique is performed. The predetermined level or value can take a variety of forms. In some embodiments, a predetermined level or value can be single cut-off value, such as a median or mean.

In some embodiments, contacting or delivering an oligonucleotide described herein (e.g., an RNAi oligonucleotide) to a cell or a population of cells results in a reduction in MARC1 expression in a cell or population of cells not contacted with the oligonucleotide or contacted with a control oligonucleotide. In some embodiments, the reduction in MARC1 expression is about 1% or lower, about 5% or lower, about 10% or lower, about 15% or lower, about 20% or lower, about 25% or lower, about 30% or lower, about 35% or lower, about 40% or lower, about 45% or lower, about 50% or lower, about 55% or lower, about 60% or lower, about 70% or lower, about 80% or lower, or about 90% or lower relative to a control amount or level of MARC1 expression. In some embodiments, the control amount or level of MARC1 expression is an amount or level of MARC1 mRNA and/or MARC1 protein in a cell or population of cells that has not been contacted with an oligonucleotide herein. In some embodiments, the effect of delivery of an oligonucleotide herein to a cell or population of cells according to a method herein is assessed after any finite period or amount of time (e.g., minutes, hours, days, weeks, months). For example, in some embodiments, MARC1 expression is determined in a cell or population of cells at least about 4 hours, about 8 hours, about 12 hours, about 18 hours, about 24 hours; or at least about 1 day, about 2 days, about 3 days, about 4 days, about 5 days, about 6 days, about 7 days, about 8 days, about 9 days, about 10 days, about 11 days, about 12 days, about 13 days, about 14 days, about 21 days, about 28 days, about 35 days, about 42 days, about 49 days, about 56 days, about 63 days, about 70 days, about 77 days, or about 84 days or more after contacting or delivering the oligonucleotide to the cell or population of cells. In some embodiments, MARC1 expression is determined in a cell or population of cells at least about 1 month, about 2 months, about 3 months, about 4 months, about 5 months, or about 6 months or more after contacting or delivering the oligonucleotide to the cell or population of cells.

In some embodiments, an oligonucleotide provided herein (e.g., an RNAi oligonucleotide) is delivered in the form of a transgene that is engineered to express in a cell the oligonucleotide or strands comprising the oligonucleotide (e.g., its sense and antisense strands). In some embodiments, an oligonucleotide herein is delivered using a transgene engineered to express any oligonucleotide disclosed herein. Transgenes may be delivered using viral vectors (e.g., adenovirus, retrovirus, vaccinia virus, poxvirus, adeno-associated virus, or herpes simplex virus) or non-viral vectors (e.g., plasmids or synthetic mRNAs). In some embodiments, transgenes can be injected directly to a subject.

Treatment Methods

The current invention provides oligonucleotides (e.g., RNAi oligonucleotides) for use as a medicament, in particular for use in a method for the treatment of diseases, disorders, and conditions associated with expression of MARC1. The current invention also provides oligonucleotides for use, or adaptable for use, to treat a subject (e.g., a human having a disease, disorder or condition associated with MARC1 expression) that would benefit from reducing MARC1 expression. In some respects, the current invention provides oligonucleotides for use, or adapted for use, to treat a subject having a disease, disorder or condition associated with expression of MARC1. The current invention also provides oligonucleotides for use, or adaptable for use, in the manufacture of a medicament or pharmaceutical composition for treating a disease, disorder or condition associated with MARC1 expression. In some embodiments, the oligonucleotides for use, or adaptable for use, target MARC1 mRNA and reduce MARC1 expression (e.g., via the RNAi pathway). In some embodiments, the oligonucleotides for use, or adaptable for use, target MARC1 mRNA and reduce the amount or level of MARC1 mRNA, MARC1 protein and/or MARC1 activity.

In addition, in some embodiments of the methods herein, a subject having a disease, disorder, or condition associated with MARC1 expression or is predisposed to the same is selected for treatment with an oligonucleotide provided herein (e.g., an RNAi oligonucleotide). In some embodiments, the method comprises selecting an individual having a marker (e.g., a biomarker) for a disease, disorder, or condition associated with MARC1 expression or predisposed to the same, such as, but not limited to, MARC1 mRNA, MARC1 protein, or a combination thereof. Likewise, and as detailed below, some embodiments of the methods provided by the current invention include steps such as measuring or obtaining a baseline value for a marker of MARC1 expression (e.g., MARC1 mRNA), and then comparing such obtained value to one or more other baseline values or values obtained after the subject is administered the oligonucleotide to assess the effectiveness of treatment.

The current invention also provides methods of treating a subject having, suspected of having, or at risk of developing a disease, disorder or condition associated with MARC1 expression with an oligonucleotide provided herein. In some aspects, the current invention provides methods of treating or attenuating the onset or progression of a disease, disorder or condition associated with MARC1 expression using the oligonucleotides herein. In other aspects, the current invention provides methods to achieve one or more therapeutic benefits in a subject having a disease, disorder, or condition associated with MARC1 expression using the oligonucleotides provided herein. In some embodiments of the methods herein, the subject is treated by administering a therapeutically effective amount of any one or more of the oligonucleotides provided herein. In some embodiments, treatment comprises reducing MARC1 expression. In some embodiments, the subject is treated therapeutically. In some embodiments, the subject is treated prophylactically.

In some embodiments of the methods herein, one or more oligonucleotides herein (e.g., RNAi oligonucleotides), or a pharmaceutical composition comprising one or more oligonucleotides, is administered to a subject having a disease, disorder or condition associated with MARC1 expression such that MARC1 expression is reduced in the subject, thereby treating the subject. In some embodiments, an amount or level of MARC1 mRNA is reduced in the subject. In some embodiments, an amount or level of MARC1 protein is reduced in the subject. In some embodiments, an amount or level of MARC1 activity is reduced in the subject.

In some embodiments of the methods herein, an oligonucleotide provided herein (e.g., an RNAi oligonucleotide), or a pharmaceutical composition comprising the oligonucleotide, is administered to a subject having a disease, disorder or condition associated with MARC1 such that MARC1 expression is reduced in the subject by at least about 30%, about 35%, about 40%, about 45%, about 50%, about 55%, about 60%, about 65%, about 70%, about 75%, about 80%, about 85%, about 90%, about 95%, about 99%, or greater than 99% when compared to MARC1 expression prior to administration of one or more oligonucleotides or pharmaceutical composition. In some embodiments, MARC1 expression is reduced in the subject by at least about 30%, about 35%, about 40%, about 45%, about 50%, about 55%, about 60%, about 65%, about 70%, about 75%, about 80%, about 85%, about 90%, about 95%, about 99%, or greater than 99% when compared to MARC1 expression in a subject (e.g., a reference or control subject) not receiving the oligonucleotide or oligonucleotides or pharmaceutical composition or receiving a control oligonucleotide or oligonucleotides, pharmaceutical composition or treatment.

In some embodiments of the methods herein, an oligonucleotide or oligonucleotides herein (e.g., RNAi oligonucleotides), or a pharmaceutical composition comprising the oligonucleotide or oligonucleotides, is administered to a subject having a disease, disorder or condition associated with MARC1 expression such that an amount or level of MARC1 mRNA is reduced in the subject by at least about 30%, about 35%, about 40%, about 45%, about 50%, about 55%, about 60%, about 65%, about 70%, about 75%, about 80%, about 85%, about 90%, about 95%, about 99%, or greater than 99% when compared to the amount or level of MARC1 mRNA prior to administration of the oligonucleotide or pharmaceutical composition. In some embodiments, an amount or level of MARC1 mRNA is reduced in the subject by at least about 30%, about 35%, about 40%, about 45%, about 50%, about 55%, about 60%, about 65%, about 70%, about 75%, about 80%, about 85%, about 90%, about 95%, about 99%, or greater than 99% when compared to an amount or level of MARC1 mRNA in a subject (e.g., a reference or control subject) not receiving the oligonucleotide or oligonucleotides or pharmaceutical composition or receiving a control oligonucleotide or oligonucleotides, pharmaceutical composition or treatment.

In some embodiments of the methods herein, an oligonucleotide or oligonucleotides herein, or a pharmaceutical composition comprising the oligonucleotide or oligonucleotides, is administered to a subject having a disease, disorder or condition associated with MARC1 expression such that an amount or level of MARC1 protein is reduced in the subject by at least about 30%, about 35%, about 40%, about 45%, about 50%, about 55%, about 60%, about 65%, about 70%, about 75%, about 80%, about 85%, about 90%, about 95%, about 99%, or greater than 99% when compared to the amount or level of MARC1 protein prior to administration of the oligonucleotide or pharmaceutical composition. In some embodiments, an amount or level of MARC1 protein is reduced in the subject by at least about 30%, about 35%, about 40%, about 45%, about 50%, about 55%, about 60%, about 65%, about 70%, about 75%, about 80%, about 85%, about 90%, about 95%, about 99%, or greater than 99% when compared to an amount or level of MARC1 protein in a subject (e.g., a reference or control subject) not receiving the oligonucleotide or oligonucleotides or pharmaceutical composition or receiving a control oligonucleotide, oligonucleotides or pharmaceutical composition or treatment.

In some embodiments of the methods herein, an oligonucleotide or oligonucleotides (e.g., RNAi oligonucleotides) herein, or a pharmaceutical composition comprising the oligonucleotide or oligonucleotides, is administered to a subject having a disease, disorder or condition associated with MARC1 such that an amount or level of MARC1 gene activity/expression is reduced in the subject by at least about 30%, about 35%, about 40%, about 45%, about 50%, about 55%, about 60%, about 65%, about 70%, about 75%, about 80%, about 85%, about 90%, about 95%, about 99%, or greater than 99% when compared to the amount or level of MARC1 activity prior to administration of the oligonucleotide or pharmaceutical composition. In some embodiments, an amount or level of MARC1 activity is reduced in the subject by at least about 30%, about 35%, about 40%, about 45%, about 50%, about 55%, about 60%, about 65%, about 70%, about 75%, about 80%, about 85%, about 90%, about 95%, about 99%, or greater than 99% when compared to an amount or level of MARC1 activity in a subject (e.g., a reference or control subject) not receiving the oligonucleotide or pharmaceutical composition or receiving a control oligonucleotide, pharmaceutical composition or treatment.

Suitable methods for determining MARC1 expression, the amount or level of MARC1 mRNA, MARC1 protein, MARC1 activity, or a biomarker related to or affected by modulation of MARC1 expression (e.g., a plasma biomarker), in the subject, or in a sample from the subject, are known in the art. Further, the Examples set forth herein illustrate methods for determining MARC1 expression.

In some embodiments, MARC1 expression, the amount or level of MARC1 mRNA, MARC1 protein, MARC1 activity, or a biomarker related to or affected by modulation of MARC1 expression, or any combination thereof, is reduced in a cell (e.g., a hepatocyte), a population or a group of cells (e.g., an organoid), an organ (e.g., liver), blood or a fraction thereof (e.g., plasma), a tissue (e.g., liver tissue), a sample (e.g., a liver biopsy sample), or any other appropriate biological material obtained or isolated from the subject. In some embodiments, MARC1 expression, the amount or level of MARC1 mRNA, MARC1 protein, MARC1 activity, or a biomarker related to or affected by modulation of MARC1 expression, or any combination thereof, is reduced in more than one type of cell (e.g., a hepatocyte and one or more other type(s) of cell), more than one groups of cells, more than one organ (e.g., liver and one or more other organ(s)), more than one fraction of blood (e.g., plasma and one or more other blood fraction(s)), more than one type of tissue (e.g., liver tissue and one or more other type(s) of tissue), or more than one type of sample (e.g., a liver biopsy sample and one or more other type(s) of biopsy sample).

Because of their high specificity, the oligonucleotides provided herein (e.g., dsRNAi oligonucleotides) specifically target mRNA of target genes (e.g., MARC1 mRNA) of cells and tissue(s), or organs(s) (e.g., in the liver). In preventing disease, the target gene may be one which is required for initiation or maintenance of the disease or which has been identified as being associated with a higher risk of contracting the disease. In treating disease, the oligonucleotide can be brought into contact with the cells, tissue(s), or organ(s) (e.g., liver) exhibiting or responsible for mediating the disease. For example, an oligonucleotide (e.g., an RNAi oligonucleotide) substantially identical to all or part of a wild-type (i.e., native) or mutated gene associated with a disorder or condition associated with MARC1 expression may be brought into contact with or introduced into a cell or tissue type of interest such as a hepatocyte or other liver cell.

Examples of a disease, disorder or condition associated with MARC1 expression include, but are not limited to non-alcoholic fatty liver disease (NAFLD), non-alcoholic steatohepatitis (NASH), alcoholic steatohepatitis (ASH), or metabolic syndrome. In some embodiments, the disease is NAFLD. In some embodiments, the disease is NASH. In some embodiments, the disease is ASH.

In some embodiments, an amount or level of liver steatosis is reduced in a subject. In some embodiments, an amount or level of liver fibrosis is reduced in a subject. In some embodiments, an amount or level of cholesterol is reduced in a subject. In some embodiments, an amount or level of triglyceride is reduced in a subject. In some embodiments, an amount or level of alanine aminotransferase is reduced in a subject. In some embodiments, an amount or level of aspartate aminotransferase is reduced in a subject. In some embodiments, any combination of the following is reduced or altered in the subject: MARC1 expression, an amount or level of MARC1 mRNA, an amount or level of MARC1 protein, an amount or level of MARC1 activity, an amount or level of TG, an amount or level of cholesterol and/or the ratio of total cholesterol to HDL cholesterol, an amount or level of liver steatosis, an amount or level of liver fibrosis, an amount of level of alanine aminotransferase, and an amount of level of aspartate aminotransferase.

In some embodiments of the methods herein, an oligonucleotide herein, or a pharmaceutical composition comprising the oligonucleotide, is administered to a subject having a disease, disorder or condition associated with MARC1 expression such that an amount or level of liver fibrosis is reduced in the subject by at least about 30%, about 35%, about 40%, about 45%, about 50%, about 55%, about 60%, about 65%, about 70%, about 75%, about 80%, about 85%, about 90%, about 95%, about 99%, or greater than 99% when compared to the amount or level of liver fibrosis prior to administration of the oligonucleotide or pharmaceutical composition. In some embodiments, an amount or level of liver fibrosis is reduced in the subject by at least about 30%, about 35%, about 40%, about 45%, about 50%, about 55%, about 60%, about 65%, about 70%, about 75%, about 80%, about 85%, about 90%, about 95%, about 99%, or greater than 99% when compared to an amount or level of liver fibrosis in a subject (e.g., a reference or control subject) not receiving the oligonucleotide or pharmaceutical composition or receiving a control oligonucleotide, pharmaceutical composition or treatment.

In some embodiments of the methods herein, an oligonucleotide herein, or a pharmaceutical composition comprising the oligonucleotide, is administered to a subject having a disease, disorder or condition associated with MARC1 expression such that an amount or level of liver steatosis is reduced in the subject by at least about 30%, about 35%, about 40%, about 45%, about 50%, about 55%, about 60%, about 65%, about 70%, about 75%, about 80%, about 85%, about 90%, about 95%, about 99%, or greater than 99% when compared to the amount or level of liver steatosis prior to administration of the oligonucleotide or pharmaceutical composition. In some embodiments, an amount or level of liver steatosis is reduced in the subject by at least about 30%, about 35%, about 40%, about 45%, about 50%, about 55%, about 60%, about 65%, about 70%, about 75%, about 80%, about 85%, about 90%, about 95%, about 99%, or greater than 99% when compared to an amount or level of liver steatosis in a subject (e.g., a reference or control subject) not receiving the oligonucleotide or pharmaceutical composition or receiving a control oligonucleotide, pharmaceutical composition or treatment.

In some embodiments of the methods herein, an oligonucleotide herein, or a pharmaceutical composition comprising the oligonucleotide, is administered to a subject having a disease, disorder or condition associated with MARC1 expression such that an amount or level of alanine aminotransferase is reduced in the subject by at least about 30%, about 35%, about 40%, about 45%, about 50%, about 55%, about 60%, about 65%, about 70%, about 75%, about 80%, about 85%, about 90%, about 95%, about 99%, or greater than 99% when compared to the amount or level of alanine aminotransferase prior to administration of the oligonucleotide or pharmaceutical composition. In some embodiments, an amount or level of alanine aminotransferase is reduced in the subject by at least about 30%, about 35%, about 40%, about 45%, about 50%, about 55%, about 60%, about 65%, about 70%, about 75%, about 80%, about 85%, about 90%, about 95%, about 99%, or greater than 99% when compared to an amount or level of alanine aminotransferase in a subject (e.g., a reference or control subject) not receiving the oligonucleotide or pharmaceutical composition or receiving a control oligonucleotide, pharmaceutical composition or treatment.

In some embodiments of the methods herein, an oligonucleotide herein, or a pharmaceutical composition comprising the oligonucleotide, is administered to a subject having a disease, disorder or condition associated with MARC1 expression such that an amount or level of aspartate aminotransferase is reduced in the subject by at least about 30%, about 35%, about 40%, about 45%, about 50%, about 55%, about 60%, about 65%, about 70%, about 75%, about 80%, about 85%, about 90%, about 95%, about 99%, or greater than 99% when compared to the amount or level of aspartate aminotransferase prior to administration of the oligonucleotide or pharmaceutical composition. In some embodiments, an amount or level of aspartate aminotransferase is reduced in the subject by at least about 30%, about 35%, about 40%, about 45%, about 50%, about 55%, about 60%, about 65%, about 70%, about 75%, about 80%, about 85%, about 90%, about 95%, about 99%, or greater than 99% when compared to an amount or level of aspartate aminotransferase in a subject (e.g., a reference or control subject) not receiving the oligonucleotide or pharmaceutical composition or receiving a control oligonucleotide, pharmaceutical composition or treatment.

In some embodiments of the methods herein, an oligonucleotide herein, or a pharmaceutical composition comprising the oligonucleotide, is administered to a subject having a disease, disorder or condition associated with MARC1 expression such that an amount or level of triglyceride is reduced in the subject by at least about 30%, about 35%, about 40%, about 45%, about 50%, about 55%, about 60%, about 65%, about 70%, about 75%, about 80%, about 85%, about 90%, about 95%, about 99%, or greater than 99% when compared to the amount or level of triglyceride prior to administration of the oligonucleotide or pharmaceutical composition. In some embodiments, an amount or level of triglyceride is reduced in the subject by at least about 30%, about 35%, about 40%, about 45%, about 50%, about 55%, about 60%, about 65%, about 70%, about 75%, about 80%, about 85%, about 90%, about 95%, about 99%, or greater than 99% when compared to an amount or level of triglyceride in a subject (e.g., a reference or control subject) not receiving the oligonucleotide or pharmaceutical composition or receiving a control oligonucleotide, pharmaceutical composition or treatment.

In some embodiments of the methods herein, an oligonucleotide herein, or a pharmaceutical composition comprising the oligonucleotide, is administered to a subject having a disease, disorder or condition associated with MARC1 expression such that an amount or level of cholesterol (e.g., total cholesterol, LDL cholesterol, and/or HDL cholesterol) is reduced in the subject by at least about 30%, about 35%, about 40%, about 45%, about 50%, about 55%, about 60%, about 65%, about 70%, about 75%, about 80%, about 85%, about 90%, about 95%, about 99%, or greater than 99% when compared to the amount or level of cholesterol prior to administration of the oligonucleotide or pharmaceutical composition. In some embodiments, an amount or level of cholesterol is reduced in the subject by at least about 30%, about 35%, about 40%, about 45%, about 50%, about 55%, about 60%, about 65%, about 70%, about 75%, about 80%, about 85%, about 90%, about 95%, about 99%, or greater than 99% when compared to an amount or level of cholesterol in a subject (e.g., a reference or control subject) not receiving the oligonucleotide or pharmaceutical composition or receiving a control oligonucleotide, pharmaceutical composition or treatment.

In some embodiments, the target gene may be a target gene from any mammal, such as a human target. Any target gene may be silenced according to the method described herein.

Methods described herein typically involve administering to a subject an effective amount of an oligonucleotide herein (e.g., a RNAi oligonucleotide), that is, an amount that produces or generates a desirable therapeutic result. A therapeutically acceptable amount may be an amount that therapeutically treats a disease or disorder. The appropriate dosage for any one subject will depend on certain factors, including the subject's size, body surface area, age, the composition to be administered, the active ingredient(s) in the composition, time and route of administration, general health, and other drugs being administered concurrently.

In some embodiments, a subject is administered any one of the compositions herein (e.g., a composition comprising an RNAi oligonucleotide described herein) either enterally (e.g., orally, by gastric feeding tube, by duodenal feeding tube, via gastrostomy or rectally), parenterally (e.g., subcutaneous injection, intravenous injection or infusion, intra-arterial injection or infusion, intraosseous infusion, intramuscular injection, intracerebral injection, intracerebroventricular injection, intrathecal), topically (e.g., epicutaneous, inhalational, via eye drops, or through a mucous membrane), or by direct injection into a target organ (e.g., the liver of a subject). Typically, oligonucleotides herein are administered intravenously or subcutaneously.

In some embodiments, an oligonucleotide herein (e.g., an RNAi oligonucleotide), or a pharmaceutical composition comprising the oligonucleotide, is administered alone or in combination. In some embodiments, the oligonucleotides herein are administered in combination concurrently, sequentially (in any order), or intermittently. For example, two oligonucleotides may be co-administered concurrently. Alternatively, one oligonucleotide may be administered and followed any amount of time later (e.g., one hour, one day, one week or one month) by the administration of a second oligonucleotide.

In some embodiments, the subject to be treated is a human or non-human primate or other mammalian subject. Other exemplary subjects include domesticated animals such as dogs and cats; livestock such as horses, cattle, pigs, sheep, goats, and chickens; and animals such as mice, rats, guinea pigs, and hamsters.

Kits

In some embodiments, the current invention provides a kit comprising an oligonucleotide herein (e.g., an RNAi oligonucleotide), and instructions for use. In some embodiments, the kit comprises an oligonucleotide herein, and a package insert containing instructions for use of the kit and/or any component thereof. In some embodiments, the kit comprises, in a suitable container, an oligonucleotide herein, one or more controls, and various buffers, reagents, enzymes and other standard ingredients well known in the art. In some embodiments, the container comprises at least one vial, well, test tube, flask, bottle, syringe, or other container means, into which the oligonucleotide is placed, and in some instances, suitably aliquoted. In some embodiments where an additional component is provided, the kit contains additional containers into which this component is placed. The kits can also include a means for containing the oligonucleotide and any other reagent in close confinement for commercial sale. Such containers may include injection or blow-molded plastic containers into which the desired vials are retained. Containers and/or kits can include labeling with instructions for use and/or warnings.

In some embodiments, a kit comprises an oligonucleotide herein (e.g., an RNAi oligonucleotide), and a pharmaceutically acceptable carrier, or a pharmaceutical composition comprising the oligonucleotide and instructions for treating or delaying progression of a disease, disorder or condition associated with MARC1 expression in a subject in need thereof.

Definitions

As used herein, the term "antisense oligonucleotide" encompasses a nucleic acid-based molecule which has a sequence complementary to all or part of the target mRNA, in particular seed sequence thereby capable of forming a duplex with a mRNA. Thus, the term "antisense oligonucleotide", as used herein, may be referred to as "complementary nucleic acid-based inhibitor".

As used herein, "approximately" or "about," as applied to one or more values of interest, refers to a value that is similar to a stated reference value. In certain embodiments, "about" refers to a range of values that fall within 25%, 20%, 19%, 18%, 17%, 16%, 15%, 14%, 13%, 12%, 11%, 10%, 9%, 8%, 7%, 6%, 5%, 4%, 3%, 2%, 1%, or less in either direction (greater than or less than) of the stated reference value unless otherwise stated or otherwise evident from the context (except where such number would exceed 100% of a possible value).

As used herein, "administer," "administering," "administration" and the like refers to providing a substance (e.g., an oligonucleotide) to a subject in a manner that is pharmacologically useful (e.g., to treat a disease, disorder, or condition in the subject).

As used herein, "attenuate," "attenuating," "attenuation" and the like refers to reducing or effectively halting. As a non-limiting example, one or more of the treatments herein may reduce or effectively halt the onset or progression of NAFLD or NASH in a subject. This attenuation may be exemplified by, for example, a decrease in one or more aspects (e.g., symptoms, tissue characteristics, and cellular, inflammatory, or immunological activity, etc.) of NAFLD, NASH, or ASH, no detectable progression (worsening) of one or more aspects of fatty liver disease, or no detectable aspects of NAFLD, NASH, or ASH) in a subject when they might otherwise be expected.

As used herein, "complementary" refers to a structural relationship between two nucleotides (e.g., on two opposing nucleic acids or on opposing regions of a single nucleic acid strand) that permits the two nucleotides to form base pairs with one another. For example, a purine nucleotide of one nucleic acid that is complementary to a pyrimidine nucleotide of an opposing nucleic acid may base pair together by forming hydrogen bonds with one another. In some embodiments, complementary nucleotides can base pair in the Watson-Crick manner or in any other manner that allows for the formation of stable duplexes. In some embodiments, two nucleic acids may have regions of multiple nucleotides that are complementary with each other to form regions of complementarity, as described herein.

As used herein, "deoxyribonucleotide" refers to a nucleotide having a hydrogen in place of a hydroxyl at the 2' position of its pentose sugar when compared with a ribonucleotide. A modified deoxyribonucleotide is a deoxyribonucleotide having one or more modifications or substitutions of atoms other than at the 2' position, including modifications or substitutions in or of the sugar, phosphate group or base.

As used herein, "double-stranded oligonucleotide" or "ds oligonucleotide" refers to an oligonucleotide that is substantially in a duplex form. In some embodiments, the complementary base-pairing of duplex region(s) of a double-stranded oligonucleotide is formed between antiparallel sequences of nucleotides of covalently separate nucleic acid strands. In some embodiments, complementary base-pairing of duplex region(s) of a double-stranded oligonucleotide is formed between antiparallel sequences of nucleotides of nucleic acid strands that are covalently linked. In some embodiments, complementary base-pairing of duplex region(s) of a double-stranded oligonucleotide is formed from single nucleic acid strand that is folded (e.g., via a hairpin) to provide complementary antiparallel sequences of nucleotides that base pair together. In some embodiments, a double-stranded oligonucleotide comprises two covalently separate nucleic acid strands that are fully duplexed with one another. However, in some embodiments, a double-stranded oligonucleotide comprises two covalently separate nucleic acid strands that are partially duplexed (e.g., having overhangs at one or both ends). In some embodiments, a double-stranded oligonucleotide comprises antiparallel sequence of nucleotides that are partially complementary, and thus, may have one or more mismatches, which may include internal mismatches or end mismatches.

As used herein, "duplex" in reference to nucleic acids (e.g., oligonucleotides), refers to a structure formed through complementary base pairing of two antiparallel sequences of nucleotides.

As used herein, "excipient" refers to a non-therapeutic agent that may be included in a composition, for example, to provide or contribute to a desired consistency or stabilizing effect.

As used herein, "hepatocyte" or "hepatocytes" refers to cells of the parenchymal tissues of the liver. These cells make up about 70%-85% of the liver's mass and manufacture serum albumin, FBN and the prothrombin group of clotting factors (except for Factors 3 and 4). Markers for hepatocyte lineage cells include, but are not limited to, transthyretin (Ttr), glutamine synthetase (Glul), hepatocyte nuclear factor 1a (Hnf1a) and hepatocyte nuclear factor 4a (Hnf4a). Markers for mature hepatocytes may include, but are not limited to, cytochrome P450 (Cyp3a11), fumarylacetoacetate hydrolase (Fah), glucose 6-phosphate (G6p), albumin (Alb) and OC2-2F8. See, e.g., Huch et al. (2013) NATURE 494:247-50.

As used herein, a "hepatotoxic agent" refers to a chemical compound, virus or other substance that is itself toxic to the liver or can be processed to form a metabolite that is toxic to the liver. Hepatotoxic agents may include, but are not limited to, carbon tetrachloride ($CCl_4$), acetaminophen (paracetamol), vinyl chloride, arsenic, chloroform, nonsteroidal anti-inflammatory drugs (such as aspirin and phenylbutazone).

As used herein, the term "MARC1" refers to Mitochondrial Amidoxime Reducing Component 1. MARC1 is a protein which catalyzes the reduction of molecules. "MARC1" may also refer to the gene which encodes the protein.

As used herein, "labile linker" refers to a linker that can be cleaved (e.g., by acidic pH). A "stable linker" refers to a linker that cannot be cleaved.

As used herein, "liver inflammation" or "hepatitis" refers to a physical condition in which the liver becomes swollen, dysfunctional and/or painful, especially as a result of injury or infection, as may be caused by exposure to a hepatotoxic agent. Symptoms may include jaundice (yellowing of the skin or eyes), fatigue, weakness, nausea, vomiting, appetite reduction and weight loss. Liver inflammation, if left untreated, may progress to fibrosis, cirrhosis, liver failure or liver cancer.

As used herein, "liver fibrosis" "Liver Fibrosis" or "fibrosis of the liver" refers to an excessive accumulation in the liver of extracellular matrix proteins, which could include collagens (I, III, and IV), FBN, undulin, elastin, laminin, hyaluronan and proteoglycans resulting from inflammation and liver cell death. Liver fibrosis, if left untreated, may progress to cirrhosis, liver failure or liver cancer.

As used herein, "loop" refers to an unpaired region of a nucleic acid (e.g., oligonucleotide) that is flanked by two antiparallel regions of the nucleic acid that are sufficiently complementary to one another, such that under appropriate hybridization conditions (e.g., in a phosphate buffer, in a cell), the two antiparallel regions, which flank the unpaired region, hybridize to form a duplex (referred to as a "stem").

As used herein, "modified internucleotide linkage" refers to an internucleotide linkage having one or more chemical modifications when compared with a reference internucleotide linkage comprising a phosphodiester bond. In some embodiments, a modified nucleotide is a non-naturally occurring linkage. Typically, a modified internucleotide linkage confers one or more desirable properties to a nucleic acid in which the modified internucleotide linkage is present. For example, a modified internucleotide linkage may improve thermal stability, resistance to degradation, nuclease resistance, solubility, bioavailability, bioactivity, reduced immunogenicity, etc.

As used herein, "modified nucleotide" refers to a nucleotide having one or more chemical modifications when compared with a corresponding reference nucleotide selected from: adenine ribonucleotide, guanine ribonucleotide, cytosine ribonucleotide, uracil ribonucleotide, adenine deoxyribonucleotide, guanine deoxyribonucleotide, cytosine deoxyribonucleotide and thymidine deoxyribonucleotide. In some embodiments, a modified nucleotide is a non-naturally occurring nucleotide. In some embodiments, a modified nucleotide has one or more chemical modification in its sugar, nucleobase and/or phosphate group. In some embodiments, a modified nucleotide has one or more chemical moieties conjugated to a corresponding reference nucleotide. Typically, a modified nucleotide confers one or more desirable properties to a nucleic acid in which the modified nucleotide is present. For example, a modified nucleotide may improve thermal stability, resistance to degradation, nuclease resistance, solubility, bioavailability, bioactivity, reduced immunogenicity, etc.

As used herein, "nicked tetraloop structure" refers to a structure of a RNAi oligonucleotide that is characterized by separate sense (passenger) and antisense (guide) strands, in which the sense strand has a region of complementarity with the antisense strand, and in which at least one of the strands, generally the sense strand, has a tetraloop configured to stabilize an adjacent stem region formed within the at least one strand.

As used herein, "oligonucleotide" refers to a short nucleic acid (e.g., less than about 100 nucleotides in length). An oligonucleotide may be single-stranded (ss) or ds. An oligonucleotide may or may not have duplex regions. As a set of non-limiting examples, an oligonucleotide may be, but is not limited to, a small interfering RNA (siRNA), microRNA (miRNA), short hairpin RNA (shRNA), dicer substrate interfering RNA (DsiRNA), antisense oligonucleotide, short siRNA or ss siRNA. In some embodiments, a double-stranded (dsRNA) is an RNAi oligonucleotide.

As used herein, "overhang" refers to terminal non-base pairing nucleotide(s) resulting from one strand or region extending beyond the terminus of a complementary strand with which the one strand or region forms a duplex. In some embodiments, an overhang comprises one or more unpaired nucleotides extending from a duplex region at the 5' terminus or 3' terminus of an oligonucleotide. In certain embodiments, the overhang is a 3'- or 5'-overhang on the antisense strand or sense strand of an oligonucleotide.

As used herein, "phosphate analog" refers to a chemical moiety that mimics the electrostatic and/or steric properties of a phosphate group. In some embodiments, the phosphate analog mimics the electrostatic and/or steric properties of a phosphate group in biologic systems. In some embodiments, a phosphate analog is positioned at the 5'-terminal nucleotide of an oligonucleotide in place of a 5'-phosphate, which is often susceptible to enzymatic removal. In some embodiments, a 5'-phosphate analog contains a phosphatase-resistant linkage. Examples of phosphate analogs include, but are not limited to, 5'-phosphonates, such as 5'-methylene phosphonate (5'-MP) and 5'-(E)-vinylphosphonate (5'-VP). In some embodiments, an oligonucleotide has a phosphate analog at a 4'-carbon position of the sugar (referred to as a "4'-phosphate analog") at a 5'-terminal nucleotide. An example of a 4'-phosphate analog is oxymethyl phosphonate, in which the oxygen atom of the oxymethyl group is bound to the sugar moiety (e.g., at its 4'-carbon) or analog thereof. See, e.g., US Patent Publication No. 2019-0177729. Other modifications have been developed for the 5' end of oligonucleotides (see, e.g., Intl. Patent Application No. WO 2011/133871; U.S. Pat. No. 8,927,513; and Prakash et al. (2015) NUCLEIC ACIDS RES. 43:2993-3011).

As used herein, "reduced expression" of a gene (e.g., MARC1) refers to a decrease in the amount or level of RNA transcript (e.g., MARC1 mRNA) or protein encoded by the gene and/or a decrease in the amount or level of activity of the gene in a cell, a population of cells, a sample, or a subject, when compared to an appropriate reference (e.g., a reference cell, population of cells, sample or subject). For example, the act of contacting a cell with an oligonucleotide herein (e.g., an oligonucleotide comprising an antisense strand having a nucleotide sequence that is complementary to a nucleotide sequence comprising MARC1 mRNA) may result in a decrease in the amount or level of MARC1 mRNA, protein and/or activity (e.g., via degradation of MARC1 mRNA by the RNAi pathway) when compared to a cell that is not treated with the oligonucleotide. Similarly, and as used herein, "reducing expression" refers to an act that results in reduced expression of a gene (e.g., MARC1). As used herein, "reduction of MARC1 expression" refers to a decrease in the amount or level of MARC1 mRNA, MARC1 protein and/or MARC1 activity in a cell, a population of cells, a sample or a subject when compared to an appropriate reference (e.g., a reference cell, population of cells, sample, or subject).

As used herein, "region of complementarity" refers to a sequence of nucleotides of a nucleic acid (e.g., an oligonucleotide) that is sufficiently complementary to an antiparallel sequence of nucleotides to permit hybridization between the two sequences of nucleotides under appropriate hybridization conditions (e.g., in a phosphate buffer, in a cell, etc.). In some embodiments, an oligonucleotide herein comprises a targeting sequence having a region of complementary to a mRNA target sequence.

As used herein, "ribonucleotide" refers to a nucleotide having a ribose as its pentose sugar, which contains a hydroxyl group at its 2' position. A modified ribonucleotide is a ribonucleotide having one or more modifications or substitutions of atoms other than at the 2' position, including modifications or substitutions in or of the ribose, phosphate group or base.

As used herein, "RNAi oligonucleotide" refers to either (a) a double-stranded oligonucleotide having a sense strand (passenger) and antisense strand (guide), in which the antisense strand or part of the antisense strand is used by the Argonaute 2 (Ago2) endonuclease in the cleavage of a target mRNA (e.g., MARC1 mRNA) or (b) a single-stranded oligonucleotide having a single antisense strand, where that antisense strand (or part of that antisense strand) is used by the Ago2 endonuclease in the cleavage of a target mRNA (e.g., MARC1 mRNA).

As used herein, "strand" refers to a single, contiguous sequence of nucleotides linked together through internucleotide linkages (e.g., phosphodiester linkages or phosphorothioate linkages). In some embodiments, a strand has two free ends (e.g., a 5' end and a 3' end).

As used herein, "subject" means any mammal, including mice, rabbits, and humans. In one embodiment, the subject is a human or NHP. Moreover, "individual" or "patient" may be used interchangeably with "subject."

As used herein, "synthetic" refers to a nucleic acid or other molecule that is artificially synthesized (e.g., using a machine (e.g., a solid-state nucleic acid synthesizer)) or that is otherwise not derived from a natural source (e.g., a cell or organism) that normally produces the molecule.

As used herein, "targeting ligand" refers to a molecule (e.g., a carbohydrate, amino sugar, cholesterol, polypeptide, or lipid) that selectively binds to a cognate molecule (e.g., a receptor) of a tissue or cell of interest and that is conjugatable to another substance for purposes of targeting the other substance to the tissue or cell of interest. For example, in some embodiments, a targeting ligand may be conjugated to an oligonucleotide for purposes of targeting the oligonucleotide to a specific tissue or cell of interest. In some embodiments, a targeting ligand selectively binds to a cell surface receptor. Accordingly, in some embodiments, a targeting ligand when conjugated to an oligonucleotide facilitates delivery of the oligonucleotide into a particular cell through selective binding to a receptor expressed on the surface of the cell and endosomal internalization by the cell of the complex comprising the oligonucleotide, targeting ligand and receptor. In some embodiments, a targeting ligand is conjugated to an oligonucleotide via a linker that is cleaved following or during cellular internalization such that the oligonucleotide is released from the targeting ligand in the cell. In some embodiments, the targeting ligand comprises at least one GalNAc moiety and targets the liver and human liver cells (e.g., human hepatocytes).

As used herein, "tetraloop" refers to a loop that increases stability of an adjacent duplex formed by hybridization of flanking sequences of nucleotides. The increase in stability is detectable as an increase in melting temperature ($T_m$) of an adjacent stem duplex that is higher than the $T_m$ of the adjacent stem duplex expected, on average, from a set of loops of comparable length consisting of randomly selected sequences of nucleotides. For example, a tetraloop can confer a $T_m$ of at least about 50° C., at least about 55° C., at least about 56° C., at least about 58° C., at least about 60° C., at least about 65° C., or at least about 75° C. in 10 mM Na2HPO4 to a hairpin comprising a duplex of at least 2 base pairs (bp) in length. In some embodiments, a tetraloop can confer a $T_m$ of at least about 50° C., at least about 55° C., at least about 56° C., at least about 58° C., at least about 60° C., at least about 65° C., or at least about 75° C. in 10 mM $NaH_2PO_4$ to a hairpin comprising a duplex of at least 2 base pairs (bp) in length. In some embodiments, a tetraloop may stabilize a bp in an adjacent stem duplex by stacking interactions. In addition, interactions among the nucleotides in a tetraloop include, but are not limited to, non-Watson-Crick base pairing, stacking interactions, hydrogen bonding and contact interactions (Cheong et al. (1990) NATURE 346:680-82; Heus & Pardi (1991) SCIENCE 253:191-94). In some embodiments, a tetraloop comprises or consists of 3 to 6 nucleotides and is typically 4 to 5 nucleotides. In certain embodiments, a tetraloop comprises or consists of 3, 4, 5, or 6 nucleotides, which may or may not be modified (e.g., which may or may not be conjugated to a targeting moiety). In one embodiment, a tetraloop consists of 4 nucleotides. Any nucleotide may be used in the tetraloop and standard IUPAC-IUB symbols for such nucleotides may be used as described in Cornish-Bowden (1985) NUCLEIC ACIDS RES. 13:3021-30. For example, the letter "N" may be used to mean that any base may be in that position, the letter "R" may be used to show that A (adenine) or G (guanine) may be in that position, and "B" may be used to show that C (cytosine), G (guanine), or T (thymine) may be in that position. Examples of tetraloops include the UNCG family of tetraloops (e.g., UUCG), the GNRA family of tetraloops (e.g., GAAA), and the CUUG tetraloop (Woese et al. (1990) PROC. NATL. ACAD. SCI. *USA* 87:8467-71; Antao et al. (1991) NUCLEIC ACIDS RES. 19:5901-05). Examples of DNA tetraloops include the d(GNNA) family of tetraloops (e.g., d(GTTA), the d(GNRA)) family of tetraloops, the d(GNAB) family of tetraloops, the d(CNNG) family of tetraloops, and the d(TNCG) family of tetraloops (e.g., d(TTCG)). See, e.g., Nakano et al. (2002) BIOCHEM. 41:14281-92; Shinji et al. (2000) NIPPON KAGAKKAI KOEN YOKOSHU 78:731. In some embodiments, the tetraloop is contained within a nicked tetraloop structure.

As used herein, "treat" or "treating" refers to the act of providing care to a subject in need thereof, for example, by administering a therapeutic agent (e.g., an oligonucleotide herein) to the subject, for purposes of improving the health and/or well-being of the subject with respect to an existing condition (e.g., a disease, disorder) or to prevent or decrease the likelihood of the occurrence of a condition. In some embodiments, treatment involves reducing the frequency or severity of at least one sign, symptom or contributing factor of a condition (e.g., disease, disorder) experienced by a subject.

EXAMPLES

While the current invention has been described with reference to the specific embodiments set forth in the following Examples, it should be understood by those skilled in the art that various changes may be made, and equivalents may be substituted without departing from the true spirit and scope of the current invention. Further, the following Examples are offered by way of illustration and are not intended to limit the scope of the current invention in any manner. In addition, modifications may be made to adapt to a situation, material, composition of matter, process, process step or steps, to the objective, spirit, and scope of the current invention. All such modifications are intended to be within the scope of the current invention. Standard techniques well known in the art or the techniques specifically described below were utilized.

Example 1: Preparation of Double-Stranded RNAi Oligonucleotides

Oligonucleotide Synthesis and Purification

The double-stranded RNAi (dsRNA) oligonucleotides described in the foregoing Examples were chemically synthesized using methods described herein. Generally, dsRNAi oligonucleotides were synthesized using solid phase oligonucleotide synthesis methods as described for 19-23mer siRNAs (see, e.g., Scaringe et al. (1990) *Nucleic Acids Res.* 18:5433-5441 and Usman et al. (1987) *J. Am. Chem. Soc.* 109:7845-7845; see also, U.S. Pat. Nos. 5,804, 683; 5,831,071; 5,998,203; 6,008,400; 6,111,086; 6,117, 657; 6,353,098; 6,362,323; 6,437,117; and 6,469,158) in addition to using known phosphoramidite synthesis (see, e.g. Hughes and Ellington (2017) *Cold Spring Harb Perspect Biol.* 9(1):a023812; Beaucage S. L., Caruthers M. H. Studies on Nucleotide Chemistry V: Deoxynucleoside Phosphoramidites—A New Class of Key Intermediates for Deoxypolynucleotide Synthesis. Tetrahedron Lett. (1981); 22:1859-1862. doi: 10.1016/S0040-4039(01)90461-7). dsRNAi oligonucleotides having a 19mer core sequence were formatted into constructs having a 25mer sense strand and a 27mer antisense strand to allow for processing by the RNAi machinery. The 19mer core sequence is complementary to a region in the MARC1 mRNA.

Individual RNA strands were synthesized and HPLC purified according to standard methods (Integrated DNA Technologies; Coralville, Iowa). For example, RNA oligonucleotides were synthesized using solid phase phosphoramidite chemistry, deprotected and desalted on NAP-5 columns (Amersham Pharmacia Biotech; Piscataway, N.J.) using standard techniques (Damha & Olgivie (1993) *Methods Mol. Biol.* 20:81-114; Wincott et al. (1995) *Nucleic Acids Res.* 23:2677-2684). The oligomers were purified using ion-exchange high performance liquid chromatography (IE-HPLC) on an Amersham Source 15Q column (1.0 cm×25 cm; Amersham Pharmacia Biotech) using a 15 min. step-linear gradient. The gradient varied from 90:10 Buffers A:B to 52:48 Buffers A:B, where Buffer A is 100 mM Tris pH 8.5 and Buffer B is 100 mM Tris pH 8.5, 1 M NaCl. Samples were monitored at 260 nm and peaks corresponding to the full-length oligonucleotide species were collected, pooled, desalted on NAP-5 columns, and lyophilized. Single strand RNA oligomers were stored lyophilized or in nuclease-free water at −80° C.

The purity of each oligomer was determined by capillary electrophoresis (CE) on a Beckman PACE 5000 (Beckman Coulter, Inc.; Fullerton, Calif.). The CE capillaries have a 100 µm inner diameter and contain ssDNA 100R Gel (Beckman-Coulter). Typically, about 0.6 nmole of oligonucleotide was injected into a capillary, run in an electric field of 444 V/cm and was detected by UV absorbance at 260 nm. Denaturing Tris-Borate-7 M-urea running buffer was purchased from Beckman-Coulter. Oligoribonucleotides were obtained that were at least 90% pure as assessed by CE for use in experiments described below. Compound identity was verified by matrix-assisted laser desorption ionization time-of-flight (MALDI-TOF) mass spectroscopy on a Voyager DE™ Biospectometry WorkStation (Applied Biosystems; Foster City, Calif.) following the manufacturer's recommended protocol. Relative molecular masses of all oligomers were obtained, often within 0.2% of expected molecular mass.

Preparation of Duplexes

Single strand RNA oligomers were resuspended (e.g., at 100 µM concentration) in duplex buffer consisting of 100 mM potassium acetate, 30 mM HEPES, pH 7.5. Complementary sense and antisense strands were mixed in equal molar amounts to yield a final solution of, for example, 50 µM duplex. Samples were heated to 100° C. for 5 min. in RNA buffer (Integrated DNA Technologies (IDT)) and were allowed to cool to room temperature before use. The dsRNA oligonucleotides were stored at −20° C.

Example 2: Generation of MARC1-Targeting Double-Stranded RNAi Oligonucleotides

Identification of MARC1 mRNA Target Sequences

MARC1 is an enzyme involved in catalyzing N-oxygenated molecules. To generate RNAi oligonucleotide inhibitors of MARC1 expression, a computer-based algorithm was used to computationally identify MARC1 mRNA target sequences suitable for assaying inhibition of MARC1 expression by the RNAi pathway. The algorithm provided RNAi oligonucleotide guide (antisense) strand sequences each having a region of complementarity to a suitable MARC1 target sequence of human MARC1 mRNA (e.g., SEQ ID NO: 1692; Table 1). Some of the guide strand sequences identified by the algorithm were also complementary to the corresponding MARC1 target sequence of monkey MARC1 mRNA (SEQ ID NO: 1693 Table 1). MARC1 RNAi oligonucleotides comprising a region of complementarity to homologous MARC1 mRNA target sequences with nucleotide sequence similarity are predicted to have the ability to target homologous MARC1 mRNAs.

TABLE 1

Sequences of Human and Monkey MARC1 mRNA

| Species | Ref Seq # | SEQ ID NO |
|---|---|---|
| Human (Hs) | NM_022746.4 | 1692 |
| Cynomolgus monkey (Mf) | XM_005540898.2 | 1693 |

RNAi oligonucleotides (formatted as DsiRNA oligonucleotides) were generated as described in Example 1 for evaluation in vitro. Each DsiRNA was generated with the same modification pattern, and each with a unique guide strand having a region of complementarity to a MARC1 target sequence identified by SEQ ID NOs: 1-384. Modifications for the sense and anti-sense DsiRNA included the following (X=any nucleotide; m=2'-O-methyl modified nucleotide; r=ribosyl modified nucleotide):

```
Sense Strand:
rXmXrXmXrXrXrXrXrXrXrXrXrXmXrXmXrXrXrXrXrXrXXX

Anti-sense Strand:
mXmXmXmXrXrXrXrXrXrXmXrXmXrXrXrXrXrXrXrXrXmXrX mXmXmX
```

In Vitro Cell-Based Assays

The ability of each of the modified DsiRNA in Table 2 to reduce MARC1 mRNA was measured using in vitro cell-based assays. Briefly, human hepatocyte (Huh7) cells expressing endogenous human MARC1 gene were transfected with each of the DsiRNAs listed in Table 2 at 1 nM in separate wells of a multi-well cell-culture plate. Cells were maintained for 24 hours following transfection with the modified DsiRNA, and then the amount of remaining MARC1 mRNA from the transfected cells was determined using TAQMAN®-based qPCR assays. Two qPCR assays, a 3' assay (Forward-(SEQ ID NO: 1684), Reverse-(SEQ ID NO: 1685), Probe-/56-FAM/AAAGG TGC T/Zen/CAG-GAGGATGGTTGT/3IABkFQ (SEQ ID NO: 1694)) and a 5' assay (Forward-(SEQ ID NO: 1686), Reverse-(SEQ ID NO: 1687), Probe-/56-FAM/TCAAAACGC/ZEN/CCAC-CACAAATGCA/3IABkFQ (SEQ ID NO: 1695)) were used to determine MARC1 mRNA levels as measured using PCR probes conjugated to 6-carboxy-fluorescein (FAM) and normalized to the HPRT housekeeping gene (Forward-(SEQ ID NO: 1688), Reverse-(SEQ ID NO: 1689); Probe-5HEX /ATGGTCAAG/ZEN/GTCGCAAGCTTGCTGGT/ 31ABkFQ/-3'(SEQ ID NO: 1696). Each primer pair was assayed for % remaining RNA as shown in Table 2 and FIG. 1. DsiRNAs resulting in less than or equal to 10% MARC1 mRNA remaining in DsiRNA-transfected cells when compared to mock-transfected cells were considered DsiRNA "hits". The Huh7 cell-based assay evaluating the ability of the DsiRNAs listed in Table 2 to inhibit MARC1 expression identified several candidate DsiRNAs.

Taken together, these results show that DsiRNAs designed to target human MARC1 mRNA inhibit MARC1 expression in cells, as determined by a reduced amount of MARC1 mRNA in DsiRNA-transfected cells relative to control cells. These results demonstrate that the nucleotide sequences comprising the DsiRNA are useful for generating RNAi oligonucleotides to inhibit MARC1 expression. Further, these results demonstrate that multiple MARC1 mRNA target sequences are suitable for the RNAi-mediated inhibition of MARC1 expression.

TABLE 2

Analysis of MARC1 mRNA in Huh7 cells

| SED ID NO (Sense Strand) | SED ID NO (Anti-sense Strand) | DsiRNA name | MARC1-5' Assay % remaining | SEM | MARC1-3' Assay % remaining | SEM |
|---|---|---|---|---|---|---|
| 769 | 1153 | MARC1-231 | 25.8 | 2.4 | 35.7 | 2.8 |
| 770 | 1154 | MARC1-233 | 40.3 | 3.3 | 39.9 | 4.9 |
| 771 | 1155 | MARC1-234 | 17.7 | 2.8 | 19.6 | 2.5 |
| 772 | 1156 | MARC1-235 | 25.0 | 3.7 | 25.4 | 3.0 |
| 773 | 1157 | MARC1-236 | 23.8 | 6.4 | 34.8 | 6.9 |
| 774 | 1158 | MARC1-237 | 35.1 | 5.8 | 40.1 | 6.0 |
| 775 | 1159 | MARC1-238 | 30.6 | 4.2 | 39.1 | 4.7 |
| 776 | 1160 | MARC1-239 | 21.6 | 3.4 | 33.0 | 5.5 |
| 777 | 1161 | MARC1-240 | 9.2 | 1.1 | 16.5 | 1.6 |
| 778 | 1162 | MARC1-241 | 29.0 | 3.3 | 36.5 | 2.6 |
| 779 | 1163 | MARC1-242 | 60.8 | 2.4 | 68.1 | 3.7 |
| 780 | 1164 | MARC1-243 | 27.9 | 3.6 | 37.4 | 4.6 |
| 781 | 1165 | MARC1-244 | 35.4 | 3.4 | 43.5 | 3.8 |
| 782 | 1166 | MARC1-245 | 72.0 | 5.2 | 89.6 | 6.7 |
| 783 | 1167 | MARC1-247 | 21.0 | 2.3 | 29.5 | 2.5 |
| 784 | 1168 | MARC1-248 | 22.0 | 2.9 | 32.3 | 5.4 |
| 785 | 1169 | MARC1-249 | 16.6 | 1.5 | 22.3 | 1.6 |
| 786 | 1170 | MARC1-253 | 29.3 | 3.5 | 30.1 | 3.0 |
| 787 | 1171 | MARC1-255 | 28.6 | 1.4 | 32.8 | 1.6 |
| 788 | 1172 | MARC1-318 | 64.7 | 3.6 | 71.7 | 5.6 |
| 789 | 1173 | MARC1-319 | 84.5 | 5.0 | 91.8 | 5.8 |
| 790 | 1174 | MARC1-320 | 42.4 | 3.0 | 59.7 | 5.5 |
| 791 | 1175 | MARC1-321 | 29.6 | 2.2 | 42.0 | 3.2 |
| 792 | 1176 | MARC1-323 | 16.2 | 1.2 | 26.0 | 2.3 |
| 793 | 1177 | MARC1-324 | 3.7 | 0.5 | 6.3 | 0.9 |
| 794 | 1178 | MARC1-325 | 24.6 | 7.4 | 29.9 | 8.8 |
| 795 | 1179 | MARC1-326 | 10.7 | 2.1 | 14.1 | 2.9 |

TABLE 2-continued

Analysis of MARC1 mRNA in Huh7 cells

| SEQ ID NO (Sense Strand) | SEQ ID NO (Anti-sense Strand) | DsiRNA name | MARC1-5' Assay % remaining | SEM | MARC1-3' Assay % remaining | SEM |
|---|---|---|---|---|---|---|
| 796 | 1180 | MARC1-327 | 10.8 | 0.6 | 16.0 | 2.0 |
| 797 | 1181 | MARC1-328 | 11.9 | 0.9 | 13.3 | 0.9 |
| 798 | 1182 | MARC1-329 | 13.4 | 0.9 | 16.2 | 1.8 |
| 799 | 1183 | MARC1-330 | 10.3 | 1.1 | 13.6 | 1.3 |
| 800 | 1184 | MARC1-331 | 11.5 | 1.1 | 12.3 | 1.2 |
| 801 | 1185 | MARC1-332 | 29.2 | 1.9 | 34.4 | 4.7 |
| 802 | 1186 | MARC1-334 | 52.6 | 4.1 | 64.5 | 5.8 |
| 803 | 1187 | MARC1-335 | 21.5 | 1.5 | 26.2 | 2.4 |
| 804 | 1188 | MARC1-337 | 31.2 | 3.6 | 32.9 | 4.4 |
| 805 | 1189 | MARC1-338 | 35.4 | 2.5 | 36.8 | 2.5 |
| 806 | 1190 | MARC1-339 | 35.1 | 5.1 | 41.7 | 5.6 |
| 807 | 1191 | MARC1-340 | 33.2 | 2.7 | 36.1 | 3.4 |
| 808 | 1192 | MARC1-341 | 17.8 | 1.2 | 20.4 | 1.9 |
| 809 | 1193 | MARC1-342 | 11.4 | 4.4 | 22.1 | 7.6 |
| 810 | 1194 | MARC1-343 | 30.6 | 2.1 | 34.5 | 3.2 |
| 811 | 1195 | MARC1-345 | 43.3 | 2.9 | 38.8 | 2.8 |
| 812 | 1196 | MARC1-346 | 19.1 | 2.5 | 22.9 | 3.4 |
| 813 | 1197 | MARC1-347 | 91.0 | 7.7 | 83.7 | 8.8 |
| 814 | 1198 | MARC1-348 | 35.8 | 3.2 | 37.9 | 3.7 |
| 815 | 1199 | MARC1-349 | 29.9 | 1.7 | 29.9 | 2.9 |
| 816 | 1200 | MARC1-350 | 40.5 | 6.7 | 30.4 | 6.3 |
| 817 | 1201 | MARC1-351 | 20.2 | 2.2 | 29.7 | 3.3 |
| 818 | 1202 | MARC1-352 | 35.5 | 3.8 | 44.5 | 4.1 |
| 819 | 1203 | MARC1-353 | 43.8 | 6.8 | 42.7 | 7.4 |
| 820 | 1204 | MARC1-354 | 54.9 | 6.1 | 58.6 | 6.2 |
| 821 | 1205 | MARC1-356 | 76.2 | 9.1 | 59.2 | 5.3 |
| 822 | 1206 | MARC1-357 | 26.0 | 4.0 | 28.5 | 3.6 |
| 823 | 1207 | MARC1-358 | 50.5 | 7.7 | 40.2 | 6.0 |
| 824 | 1208 | MARC1-359 | 68.7 | 7.5 | 53.4 | 6.2 |
| 825 | 1209 | MARC1-360 | 22.5 | 1.4 | 34.6 | 2.5 |
| 826 | 1210 | MARC1-361 | 63.0 | 7.1 | 72.8 | 6.5 |
| 827 | 1211 | MARC1-362 | 61.4 | 5.9 | 63.8 | 5.8 |
| 828 | 1212 | MARC1-365 | 70.5 | 4.1 | 66.5 | 4.2 |
| 829 | 1213 | MARC1-376 | 90.8 | 6.8 | 70.2 | 7.2 |
| 830 | 1214 | MARC1-379 | 95.1 | 7.6 | 82.4 | 7.8 |
| 831 | 1215 | MARC1-384 | 44.8 | 5.2 | 36.5 | 3.6 |
| 832 | 1216 | MARC1-385 | 62.4 | 5.2 | 46.9 | 5.1 |
| 833 | 1217 | MARC1-388 | 29.0 | 3.1 | 32.2 | 3.2 |
| 834 | 1218 | MARC1-390 | 43.1 | 1.7 | 48.7 | 2.6 |
| 835 | 1219 | MARC1-391 | 29.9 | 3.7 | 33.2 | 3.7 |
| 836 | 1220 | MARC1-393 | 36.6 | 1.4 | 35.8 | 1.8 |
| 837 | 1221 | MARC1-395 | 68.6 | 4.1 | 68.0 | 4.3 |
| 838 | 1222 | MARC1-405 | 19.2 | 2.1 | 24.1 | 2.8 |
| 839 | 1223 | MARC1-409 | 29.7 | 3.0 | 33.9 | 3.6 |
| 840 | 1224 | MARC1-411 | 50.4 | 3.7 | 46.1 | 3.8 |
| 841 | 1225 | MARC1-412 | 31.4 | 2.2 | 35.9 | 2.6 |
| 842 | 1226 | MARC1-413 | 16.1 | 1.8 | 21.8 | 3.1 |
| 843 | 1227 | MARC1-414 | 28.1 | 3.5 | 25.8 | 2.9 |
| 844 | 1228 | MARC1-415 | 19.8 | 4.5 | 30.4 | 6.5 |
| 845 | 1229 | MARC1-416 | 16.9 | 2.2 | 20.4 | 1.8 |
| 846 | 1230 | MARC1-417 | 34.4 | 3.6 | 36.6 | 3.3 |
| 847 | 1231 | MARC1-418 | 46.9 | 5.0 | 45.2 | 4.8 |
| 848 | 1232 | MARC1-419 | 24.8 | 3.3 | 27.0 | 3.1 |
| 849 | 1233 | MARC1-420 | 68.4 | 6.5 | 77.6 | 9.1 |
| 850 | 1234 | MARC1-421 | 14.6 | 1.0 | 25.2 | 2.2 |
| 851 | 1235 | MARC1-422 | 25.9 | 1.5 | 27.7 | 1.4 |
| 852 | 1236 | MARC1-423 | 15.5 | 1.0 | 18.3 | 1.6 |
| 853 | 1237 | MARC1-424 | 32.2 | 3.1 | 31.1 | 5.0 |
| 854 | 1238 | MARC1-425 | 42.7 | 3.7 | 41.5 | 4.4 |
| 855 | 1239 | MARC1-426 | 33.6 | 2.5 | 38.2 | 3.7 |
| 856 | 1240 | MARC1-427 | 20.1 | 1.3 | 28.6 | 2.4 |
| 857 | 1241 | MARC1-428 | 46.5 | 8.1 | 69.6 | 11.3 |
| 858 | 1242 | MARC1-429 | 17.4 | 1.8 | 33.6 | 3.5 |
| 859 | 1243 | MARC1-430 | 29.1 | 3.2 | 42.1 | 5.0 |
| 860 | 1244 | MARC1-431 | 23.1 | 2.7 | 40.8 | 3.5 |
| 861 | 1245 | MARC1-433 | 12.5 | 0.7 | 20.2 | 1.7 |
| 862 | 1246 | MARC1-434 | 16.0 | 1.3 | 24.7 | 1.8 |
| 863 | 1247 | MARC1-435 | 18.7 | 2.0 | 26.8 | 2.5 |
| 864 | 1248 | MARC1-436 | 42.1 | 3.7 | 62.6 | 5.9 |
| 865 | 1249 | MARC1-437 | 20.1 | 2.2 | 42.8 | 9.0 |
| 866 | 1250 | MARC1-438 | 35.8 | 3.4 | 36.0 | 3.6 |
| 867 | 1251 | MARC1-439 | 21.0 | 2.6 | 26.4 | 3.0 |
| 868 | 1252 | MARC1-440 | 38.0 | 11.5 | 104.7 | 29.2 |

TABLE 2-continued

Analysis of MARC1 mRNA in Huh7 cells

| SED ID NO (Sense Strand) | SED ID NO (Anti-sense Strand) | DsiRNA name | MARC1-5' Assay % remaining | SEM | MARC1-3' Assay % remaining | SEM |
|---|---|---|---|---|---|---|
| 869 | 1253 | MARC1-441 | 18.7 | 1.7 | 23.7 | 2.0 |
| 870 | 1254 | MARC1-445 | 30.1 | 3.4 | 36.6 | 3.4 |
| 871 | 1255 | MARC1-446 | 14.2 | 2.8 | 25.0 | 3.9 |
| 872 | 1256 | MARC1-447 | 25.4 | 6.7 | 35.9 | 8.2 |
| 873 | 1257 | MARC1-448 | 26.9 | 5.3 | 27.5 | 4.5 |
| 874 | 1258 | MARC1-449 | 22.4 | 3.3 | 26.9 | 4.4 |
| 875 | 1259 | MARC1-450 | 21.1 | 1.3 | 22.8 | 1.7 |
| 876 | 1260 | MARC1-451 | 30.6 | 1.5 | 33.4 | 1.9 |
| 877 | 1261 | MARC1-452 | 78.5 | 9.6 | 85.6 | 16.8 |
| 878 | 1262 | MARC1-453 | 44.4 | 2.3 | 49.4 | 3.2 |
| 879 | 1263 | MARC1-454 | 29.1 | 2.7 | 43.3 | 3.5 |
| 880 | 1264 | MARC1-456 | 19.7 | 2.3 | 24.6 | 2.7 |
| 881 | 1265 | MARC1-457 | 14.6 | 1.5 | 25.1 | 2.3 |
| 882 | 1266 | MARC1-458 | 18.1 | 1.2 | 25.1 | 3.3 |
| 883 | 1267 | MARC1-459 | 29.4 | 1.7 | 35.1 | 3.3 |
| 884 | 1268 | MARC1-460 | 30.5 | 1.5 | 34.0 | 3.2 |
| 885 | 1269 | MARC1-462 | 33.2 | 3.3 | 38.2 | 3.9 |
| 886 | 1270 | MARC1-468 | 49.0 | 4.2 | 61.9 | 7.9 |
| 887 | 1271 | MARC1-469 | 24.5 | 1.6 | 28.9 | 2.9 |
| 888 | 1272 | MARC1-470 | 32.1 | 3.3 | 35.5 | 4.3 |
| 889 | 1273 | MARC1-471 | 39.8 | 1.7 | 48.7 | 2.4 |
| 890 | 1274 | MARC1-473 | 27.1 | 1.9 | 32.1 | 2.6 |
| 891 | 1275 | MARC1-475 | 78.8 | 2.8 | 70.6 | 2.3 |
| 892 | 1276 | MARC1-476 | 108.2 | 7.7 | 107.7 | 8.6 |
| 893 | 1277 | MARC1-482 | 36.1 | 2.3 | 39.0 | 3.2 |
| 894 | 1278 | MARC1-483 | 28.8 | 1.7 | 43.0 | 2.5 |
| 895 | 1279 | MARC1-484 | 33.9 | 3.0 | 44.0 | 5.3 |
| 896 | 1280 | MARC1-552 | 44.8 | 3.3 | 70.4 | 7.3 |
| 897 | 1281 | MARC1-553 | 17.9 | 1.0 | 32.0 | 1.8 |
| 898 | 1282 | MARC1-554 | 21.9 | 2.2 | 31.8 | 2.0 |
| 899 | 1283 | MARC1-555 | 28.6 | 2.1 | 40.5 | 3.6 |
| 900 | 1284 | MARC1-556 | 18.5 | 0.8 | 27.8 | 1.6 |
| 901 | 1285 | MARC1-557 | 25.3 | 2.0 | 31.6 | 2.7 |
| 902 | 1286 | MARC1-558 | 43.5 | 2.7 | 66.1 | 5.3 |
| 903 | 1287 | MARC1-559 | 41.0 | 2.6 | 47.0 | 3.2 |
| 904 | 1288 | MARC1-560 | 21.3 | 1.5 | 37.7 | 3.1 |
| 905 | 1289 | MARC1-561 | 19.8 | 1.5 | 26.1 | 2.1 |
| 906 | 1290 | MARC1-562 | 78.6 | 4.6 | 85.6 | 8.3 |
| 907 | 1291 | MARC1-563 | 61.7 | 3.3 | 73.4 | 4.2 |
| 908 | 1292 | MARC1-564 | 31.4 | 2.3 | 37.6 | 3.3 |
| 909 | 1293 | MARC1-565 | 56.3 | 3.7 | 60.5 | 4.8 |
| 910 | 1294 | MARC1-566 | 41.7 | 5.4 | 53.1 | 5.8 |
| 911 | 1295 | MARC1-567 | 68.1 | 5.1 | 76.5 | 6.7 |
| 912 | 1296 | MARC1-568 | 46.7 | 3.5 | 67.5 | 5.8 |
| 913 | 1297 | MARC1-589 | 23.4 | 2.2 | 35.4 | 2.6 |
| 914 | 1298 | MARC1-591 | 14.9 | 1.1 | 21.5 | 2.9 |
| 915 | 1299 | MARC1-592 | 21.8 | 3.2 | 24.8 | 4.2 |
| 916 | 1300 | MARC1-593 | 71.2 | 7.2 | 96.1 | 12.4 |
| 917 | 1301 | MARC1-597 | 43.2 | 2.6 | 53.7 | 5.2 |
| 918 | 1302 | MARC1-600 | 24.1 | 5.7 | 29.1 | 5.7 |
| 919 | 1303 | MARC1-612 | 22.6 | 2.0 | 26.3 | 2.4 |
| 920 | 1304 | MARC1-614 | 34.2 | 4.1 | 48.3 | 7.2 |
| 921 | 1305 | MARC1-617 | 59.0 | 6.1 | 75.3 | 8.1 |
| 922 | 1306 | MARC1-618 | 22.8 | 1.4 | 37.6 | 3.0 |
| 923 | 1307 | MARC1-620 | 28.9 | 1.8 | 39.9 | 3.2 |
| 924 | 1308 | MARC1-621 | 32.0 | 4.6 | 34.8 | 4.0 |
| 925 | 1309 | MARC1-622 | 14.6 | 1.0 | 23.4 | 1.6 |
| 926 | 1310 | MARC1-623 | 28.6 | 2.1 | 36.3 | 2.8 |
| 927 | 1311 | MARC1-624 | 30.6 | 2.6 | 36.4 | 3.1 |
| 928 | 1312 | MARC1-625 | 38.3 | 4.8 | 39.0 | 5.4 |
| 929 | 1313 | MARC1-626 | 21.1 | 2.6 | 25.5 | 2.9 |
| 930 | 1314 | MARC1-627 | 14.5 | 1.3 | 17.9 | 1.7 |
| 931 | 1315 | MARC1-628 | 39.6 | 3.9 | 43.3 | 3.8 |
| 932 | 1316 | MARC1-629 | 54.1 | 3.6 | 52.5 | 2.9 |
| 933 | 1317 | MARC1-630 | 25.9 | 3.4 | 35.6 | 4.1 |
| 934 | 1318 | MARC1-631 | 19.8 | 1.2 | 29.5 | 2.4 |
| 935 | 1319 | MARC1-632 | 17.7 | 2.1 | 22.3 | 2.1 |
| 936 | 1320 | MARC1-633 | 16.9 | 1.0 | 20.2 | 1.9 |
| 937 | 1321 | MARC1-634 | 21.4 | 1.2 | 39.9 | 4.1 |
| 938 | 1322 | MARC1-635 | 23.2 | 1.9 | 26.1 | 2.9 |
| 939 | 1323 | MARC1-636 | 45.3 | 1.6 | 38.1 | 1.9 |
| 940 | 1324 | MARC1-637 | 53.9 | 6.0 | 54.5 | 9.8 |
| 941 | 1325 | MARC1-638 | 15.2 | 0.9 | 21.9 | 1.6 |

TABLE 2-continued

Analysis of MARC1 mRNA in Huh7 cells

| SEQ ID NO (Sense Strand) | SEQ ID NO (Anti-sense Strand) | DsiRNA name | MARC1-5' Assay % remaining | SEM | MARC1-3' Assay % remaining | SEM |
|---|---|---|---|---|---|---|
| 942 | 1326 | MARC1-639 | 17.7 | 1.3 | 23.9 | 2.9 |
| 943 | 1327 | MARC1-640 | 29.5 | 3.6 | 36.9 | 4.2 |
| 944 | 1328 | MARC1-641 | 22.8 | 2.4 | 45.1 | 7.5 |
| 945 | 1329 | MARC1-642 | 19.2 | 1.9 | 47.2 | 5.3 |
| 946 | 1330 | MARC1-643 | 19.4 | 1.1 | 27.6 | 2.8 |
| 947 | 1331 | MARC1-644 | 24.2 | 1.7 | 30.0 | 4.5 |
| 948 | 1332 | MARC1-645 | 37.6 | 2.3 | 44.5 | 3.2 |
| 949 | 1333 | MARC1-646 | 41.5 | 2.5 | 43.1 | 4.1 |
| 950 | 1334 | MARC1-647 | 46.5 | 4.2 | 49.6 | 5.2 |
| 951 | 1335 | MARC1-648 | 19.0 | 1.6 | 27.0 | 3.6 |
| 952 | 1336 | MARC1-649 | 35.7 | 5.0 | 39.8 | 5.7 |
| 953 | 1337 | MARC1-650 | 72.2 | 6.8 | 84.2 | 5.8 |
| 954 | 1338 | MARC1-651 | 71.7 | 4.7 | 70.7 | 6.9 |
| 955 | 1339 | MARC1-652 | 57.0 | 2.1 | 62.3 | 8.8 |
| 956 | 1340 | MARC1-653 | 18.2 | 1.4 | 20.7 | 2.4 |
| 957 | 1341 | MARC1-654 | 17.9 | 1.0 | 19.5 | 1.5 |
| 958 | 1342 | MARC1-655 | 71.5 | 7.0 | 71.2 | 9.3 |
| 959 | 1343 | MARC1-656 | 41.9 | 3.6 | 44.1 | 4.4 |
| 960 | 1344 | MARC1-657 | 18.2 | 2.8 | 21.7 | 3.1 |
| 961 | 1345 | MARC1-658 | 30.2 | 2.1 | 45.9 | 2.7 |
| 962 | 1346 | MARC1-659 | 47.1 | 14.7 | 51.8 | 11.1 |
| 963 | 1347 | MARC1-660 | 17.7 | 1.7 | 23.6 | 2.0 |
| 964 | 1348 | MARC1-661 | 13.0 | 1.4 | 20.4 | 2.5 |
| 965 | 1349 | MARC1-662 | 25.5 | 2.4 | 30.9 | 2.6 |
| 966 | 1350 | MARC1-663 | 34.3 | 3.5 | 36.3 | 3.4 |
| 967 | 1351 | MARC1-664 | 37.1 | 4.4 | 41.9 | 4.1 |
| 968 | 1352 | MARC1-665 | 22.5 | 2.2 | 37.8 | 3.6 |
| 969 | 1353 | MARC1-666 | 17.8 | 1.9 | 32.6 | 4.5 |
| 970 | 1354 | MARC1-667 | 27.4 | 5.0 | 32.6 | 7.3 |
| 971 | 1355 | MARC1-668 | 45.6 | 3.0 | 58.0 | 2.8 |
| 972 | 1356 | MARC1-669 | 33.1 | 2.4 | 42.1 | 2.8 |
| 973 | 1357 | MARC1-670 | 26.3 | 2.7 | 29.7 | 2.6 |
| 974 | 1358 | MARC1-671 | 62.9 | 3.4 | 66.9 | 6.9 |
| 975 | 1359 | MARC1-672 | 60.3 | 3.5 | 70.9 | 5.1 |
| 976 | 1360 | MARC1-673 | 38.8 | 4.0 | 56.7 | 8.1 |
| 977 | 1361 | MARC1-674 | 21.4 | 1.5 | 37.8 | 2.9 |
| 978 | 1362 | MARC1-675 | 47.6 | 3.7 | 51.1 | 4.0 |
| 979 | 1363 | MARC1-676 | 53.9 | 4.1 | 54.2 | 4.9 |
| 980 | 1364 | MARC1-677 | 44.5 | 8.6 | 69.6 | 17.2 |
| 981 | 1365 | MARC1-678 | 38.1 | 3.8 | 37.7 | 4.3 |
| 982 | 1366 | MARC1-679 | 50.7 | 3.6 | 49.1 | 6.0 |
| 983 | 1367 | MARC1-680 | 27.5 | 1.8 | 29.5 | 2.0 |
| 984 | 1368 | MARC1-681 | 24.9 | 2.1 | 32.7 | 2.0 |
| 985 | 1369 | MARC1-682 | 51.4 | 2.4 | 55.4 | 2.2 |
| 986 | 1370 | MARC1-683 | 28.0 | 1.7 | 26.9 | 2.5 |
| 987 | 1371 | MARC1-684 | 23.8 | 2.1 | 23.8 | 3.0 |
| 988 | 1372 | MARC1-685 | 72.2 | 13.5 | 81.3 | 15.1 |
| 989 | 1373 | MARC1-686 | 18.8 | 1.2 | 20.5 | 3.4 |
| 990 | 1374 | MARC1-687 | 18.0 | 1.8 | 22.3 | 3.1 |
| 991 | 1375 | MARC1-691 | 21.8 | 2.3 | 23.6 | 2.6 |
| 992 | 1376 | MARC1-692 | 25.7 | 2.9 | 25.4 | 2.7 |
| 993 | 1377 | MARC1-724 | 49.0 | 2.8 | 74.6 | 10.5 |
| 994 | 1378 | MARC1-726 | 36.6 | 3.5 | 37.6 | 4.1 |
| 995 | 1379 | MARC1-728 | 38.9 | 3.1 | 40.0 | 4.2 |
| 996 | 1380 | MARC1-729 | 31.8 | 3.4 | 36.0 | 4.8 |
| 997 | 1381 | MARC1-730 | 62.3 | 3.1 | 60.0 | 7.8 |
| 998 | 1382 | MARC1-731 | 66.0 | 6.6 | 66.1 | 6.8 |
| 999 | 1383 | MARC1-733 | 33.8 | 4.4 | 28.0 | 3.7 |
| 1000 | 1384 | MARC1-734 | 17.7 | 2.0 | 25.8 | 3.4 |
| 1001 | 1385 | MARC1-735 | 9.5 | 1.4 | 16.7 | 2.2 |
| 1002 | 1386 | MARC1-736 | 12.0 | 2.1 | 13.5 | 1.7 |
| 1003 | 1387 | MARC1-737 | 17.0 | 1.0 | 18.8 | 1.2 |
| 1004 | 1388 | MARC1-738 | 25.6 | 4.5 | 24.0 | 4.0 |
| 1005 | 1389 | MARC1-739 | 19.1 | 2.2 | 16.2 | 1.3 |
| 1006 | 1390 | MARC1-740 | 31.5 | 3.5 | 30.1 | 3.5 |
| 1007 | 1391 | MARC1-741 | 36.4 | 2.7 | 29.1 | 2.6 |
| 1008 | 1392 | MARC1-742 | 32.9 | 5.4 | 29.7 | 4.7 |
| 1009 | 1393 | MARC1-743 | 45.3 | 5.5 | 59.2 | 5.0 |
| 1010 | 1394 | MARC1-744 | 25.4 | 2.6 | 34.7 | 2.7 |
| 1011 | 1395 | MARC1-745 | 23.2 | 2.7 | 27.8 | 4.6 |
| 1012 | 1396 | MARC1-746 | 121.1 | 19.5 | 153.6 | 26.6 |
| 1013 | 1397 | MARC1-747 | 29.4 | 3.2 | 33.1 | 3.4 |
| 1014 | 1398 | MARC1-748 | 26.9 | 4.1 | 30.0 | 4.9 |

TABLE 2-continued

Analysis of MARC1 mRNA in Huh7 cells

| SED ID NO (Sense Strand) | SED ID NO (Anti-sense Strand) | DsiRNA name | MARC1-5' Assay % remaining | SEM | MARC1-3' Assay % remaining | SEM |
|---|---|---|---|---|---|---|
| 1015 | 1399 | MARC1-750 | 33.3 | 6.4 | 36.3 | 6.3 |
| 1016 | 1400 | MARC1-751 | 35.1 | 5.3 | 42.0 | 8.0 |
| 1017 | 1401 | MARC1-752 | 22.9 | 2.6 | 27.1 | 5.4 |
| 1018 | 1402 | MARC1-753 | 41.3 | 2.5 | 42.9 | 2.8 |
| 1019 | 1403 | MARC1-754 | 84.7 | 7.7 | 57.0 | 5.7 |
| 1020 | 1404 | MARC1-755 | 22.1 | 1.5 | 31.3 | 6.5 |
| 1021 | 1405 | MARC1-756 | 46.6 | 2.1 | 46.2 | 2.5 |
| 1022 | 1406 | MARC1-758 | 36.5 | 5.4 | 43.8 | 5.8 |
| 1023 | 1407 | MARC1-759 | 57.6 | 10.7 | 73.2 | 15.8 |
| 1024 | 1408 | MARC1-760 | 33.0 | 6.1 | 41.1 | 10.1 |
| 1025 | 1409 | MARC1-761 | 16.1 | 1.8 | 19.6 | 2.7 |
| 1026 | 1410 | MARC1-762 | 16.3 | 1.0 | 20.3 | 1.8 |
| 1027 | 1411 | MARC1-763 | 22.9 | 1.5 | 25.1 | 2.3 |
| 1028 | 1412 | MARC1-764 | 43.1 | 1.7 | 49.5 | 3.2 |
| 1029 | 1413 | MARC1-765 | 57.2 | 5.0 | 50.2 | 4.5 |
| 1030 | 1414 | MARC1-766 | 30.2 | 2.1 | 35.3 | 3.8 |
| 1031 | 1415 | MARC1-767 | 84.0 | 12.8 | 83.7 | 19.5 |
| 1032 | 1416 | MARC1-768 | 20.9 | 3.5 | 22.9 | 4.2 |
| 1033 | 1417 | MARC1-769 | 21.0 | 3.8 | 29.6 | 3.4 |
| 1034 | 1418 | MARC1-770 | 24.1 | 1.3 | 29.9 | 1.6 |
| 1035 | 1419 | MARC1-771 | 40.2 | 2.9 | 35.8 | 2.7 |
| 1036 | 1420 | MARC1-772 | 80.6 | 29.6 | 123.8 | 45.0 |
| 1037 | 1421 | MARC1-773 | 37.5 | 2.6 | 39.5 | 4.7 |
| 1038 | 1422 | MARC1-774 | 19.5 | 1.4 | 24.3 | 2.2 |
| 1039 | 1423 | MARC1-775 | 18.6 | 1.5 | 22.5 | 2.7 |
| 1040 | 1424 | MARC1-776 | 32.4 | 4.4 | 39.9 | 5.9 |
| 1041 | 1425 | MARC1-777 | 28.7 | 1.9 | 33.7 | 2.4 |
| 1042 | 1426 | MARC1-778 | 18.7 | 1.5 | 25.3 | 2.3 |
| 1043 | 1427 | MARC1-779 | 24.6 | 3.0 | 41.9 | 7.7 |
| 1044 | 1428 | MARC1-780 | 22.5 | 4.3 | 32.3 | 7.0 |
| 1045 | 1429 | MARC1-781 | 25.8 | 2.3 | 25.7 | 2.2 |
| 1046 | 1430 | MARC1-782 | 19.4 | 3.9 | 30.7 | 7.7 |
| 1047 | 1431 | MARC1-783 | 23.2 | 3.9 | 27.1 | 4.5 |
| 1048 | 1432 | MARC1-784 | 19.6 | 2.9 | 27.1 | 4.3 |
| 1049 | 1433 | MARC1-785 | 15.2 | 0.9 | 19.1 | 1.8 |
| 1050 | 1434 | MARC1-786 | 41.3 | 3.9 | 44.4 | 6.4 |
| 1051 | 1435 | MARC1-787 | 25.2 | 3.3 | 27.4 | 3.8 |
| 1052 | 1436 | MARC1-788 | 12.7 | 1.2 | 18.7 | 1.4 |
| 1053 | 1437 | MARC1-789 | 15.2 | 1.6 | 21.0 | 2.2 |
| 1054 | 1438 | MARC1-790 | 20.3 | 2.3 | 25.1 | 3.1 |
| 1055 | 1439 | MARC1-791 | 29.7 | 2.4 | 32.2 | 2.5 |
| 1056 | 1440 | MARC1-792 | 36.7 | 4.8 | 43.2 | 5.9 |
| 1057 | 1441 | MARC1-863 | 11.8 | 1.8 | 18.6 | 1.8 |
| 1058 | 1442 | MARC1-929 | 37.4 | 6.8 | 42.9 | 8.0 |
| 1059 | 1443 | MARC1-930 | 54.5 | 6.6 | 60.7 | 10.4 |
| 1060 | 1444 | MARC1-934 | 55.3 | 8.2 | 78.8 | 12.0 |
| 1061 | 1445 | MARC1-955 | 37.2 | 4.9 | 41.5 | 5.7 |
| 1062 | 1446 | MARC1-959 | 17.8 | 1.8 | 22.1 | 1.7 |
| 1063 | 1447 | MARC1-960 | 25.2 | 2.5 | 29.9 | 5.9 |
| 1064 | 1448 | MARC1-963 | 32.1 | 4.3 | 34.8 | 6.4 |
| 1065 | 1449 | MARC1-964 | 20.0 | 2.3 | 23.0 | 2.9 |
| 1066 | 1450 | MARC1-965 | 15.2 | 1.2 | 21.0 | 1.0 |
| 1067 | 1451 | MARC1-966 | 19.9 | 0.9 | 22.2 | 1.7 |
| 1068 | 1452 | MARC1-967 | 18.4 | 2.7 | 25.0 | 7.0 |
| 1069 | 1453 | MARC1-969 | 19.9 | 1.4 | 23.5 | 1.6 |
| 1070 | 1454 | MARC1-970 | 28.1 | 1.6 | 30.7 | 3.8 |
| 1071 | 1455 | MARC1-971 | 24.2 | 1.6 | 26.3 | 2.4 |
| 1072 | 1456 | MARC1-1107 | 24.2 | 3.9 | 24.7 | 4.7 |
| 1073 | 1457 | MARC1-1113 | 49.9 | 4.3 | 56.3 | 6.4 |
| 1074 | 1458 | MARC1-1118 | 18.2 | 1.6 | 21.9 | 2.1 |
| 1075 | 1459 | MARC1-1123 | 25.7 | 2.5 | 28.3 | 1.2 |
| 1076 | 1460 | MARC1-1126 | 21.1 | 7.6 | 27.2 | 10.2 |
| 1077 | 1461 | MARC1-1127 | 29.6 | 2.4 | 29.6 | 2.6 |
| 1078 | 1462 | MARC1-1128 | 23.9 | 1.0 | 27.8 | 2.0 |
| 1079 | 1463 | MARC1-1129 | 27.1 | 4.1 | 33.3 | 5.0 |
| 1080 | 1464 | MARC1-1130 | 34.3 | 5.3 | 32.6 | 4.9 |
| 1081 | 1465 | MARC1-1132 | 24.3 | 2.6 | 19.2 | 4.1 |
| 1082 | 1466 | MARC1-1133 | 26.2 | 3.1 | 31.0 | 3.6 |
| 1083 | 1467 | MARC1-1134 | 21.3 | 1.6 | 21.9 | 1.5 |
| 1084 | 1468 | MARC1-1135 | 36.3 | 7.5 | 36.5 | 10.8 |
| 1085 | 1469 | MARC1-1139 | 25.3 | 2.3 | 25.3 | 1.6 |
| 1086 | 1470 | MARC1-1144 | 49.8 | 7.4 | 48.3 | 9.1 |
| 1087 | 1471 | MARC1-1165 | 38.9 | 6.7 | 35.7 | 6.2 |

TABLE 2-continued

Analysis of MARC1 mRNA in Huh7 cells

| SED ID NO (Sense Strand) | SED ID NO (Anti-sense Strand) | DsiRNA name | MARC1-5' Assay % remaining | SEM | MARC1-3' Assay % remaining | SEM |
|---|---|---|---|---|---|---|
| 1088 | 1472 | MARC1-1167 | 90.1 | 7.0 | 61.4 | 9.1 |
| 1089 | 1473 | MARC1-1173 | 32.7 | 2.4 | 35.8 | 6.1 |
| 1090 | 1474 | MARC1-1177 | 14.9 | 1.2 | 20.4 | 2.1 |
| 1091 | 1475 | MARC1-1179 | 11.6 | 0.7 | 13.4 | 1.5 |
| 1092 | 1476 | MARC1-1329 | 24.9 | 1.8 | 26.6 | 2.3 |
| 1093 | 1477 | MARC1-1330 | 23.4 | 1.7 | 23.5 | 1.8 |
| 1094 | 1478 | MARC1-1332 | 33.9 | 5.1 | 32.9 | 5.5 |
| 1095 | 1479 | MARC1-1333 | 48.9 | 6.1 | 50.8 | 6.9 |
| 1096 | 1480 | MARC1-1334 | 34.7 | 7.0 | 31.1 | 6.8 |
| 1097 | 1481 | MARC1-1335 | 16.8 | 1.5 | 19.2 | 2.4 |
| 1098 | 1482 | MARC1-1620 | 18.9 | 2.7 | 18.1 | 3.0 |
| 1099 | 1483 | MARC1-1622 | 22.1 | 1.5 | 21.2 | 1.5 |
| 1100 | 1484 | MARC1-1660 | 29.6 | 6.1 | 23.2 | 4.1 |
| 1101 | 1485 | MARC1-1663 | 39.1 | 3.9 | 33.8 | 5.5 |
| 1102 | 1486 | MARC1-1664 | 26.5 | 3.4 | 23.2 | 3.3 |
| 1103 | 1487 | MARC1-1812 | 30.7 | 2.6 | 26.3 | 2.9 |
| 1104 | 1488 | MARC1-1816 | 41.2 | 10.1 | 27.3 | 7.3 |
| 1105 | 1489 | MARC1-1868 | 21.0 | 4.7 | 27.9 | 5.8 |
| 1106 | 1490 | MARC1-1869 | 25.7 | 3.6 | 28.5 | 5.6 |
| 1107 | 1491 | MARC1-1876 | 20.4 | 1.9 | 15.6 | 1.9 |
| 1108 | 1492 | MARC1-1877 | 33.1 | 1.6 | 20.1 | 3.9 |
| 1109 | 1493 | MARC1-1878 | 24.1 | 1.3 | 17.3 | 2.1 |
| 1110 | 1494 | MARC1-1879 | 27.4 | 4.3 | 18.8 | 3.3 |
| 1111 | 1495 | MARC1-1882 | 29.8 | 3.3 | 17.4 | 3.2 |
| 1112 | 1496 | MARC1-1883 | 34.8 | 6.8 | 13.0 | 3.3 |
| 1113 | 1497 | MARC1-1884 | 22.6 | 2.0 | 20.6 | 4.7 |
| 1114 | 1498 | MARC1-1885 | 20.2 | 1.9 | 13.8 | 2.0 |
| 1115 | 1499 | MARC1-1886 | 28.6 | 3.2 | 25.6 | 4.0 |
| 1116 | 1500 | MARC1-1935 | 25.6 | 1.8 | 23.2 | 1.4 |
| 1117 | 1501 | MARC1-1936 | 38.8 | 3.3 | 17.0 | 2.8 |
| 1118 | 1502 | MARC1-1937 | 25.4 | 3.0 | 15.9 | 4.2 |
| 1119 | 1503 | MARC1-1939 | 60.6 | 6.1 | 25.1 | 4.1 |
| 1120 | 1504 | MARC1-1941 | 36.9 | 7.7 | 27.4 | 9.8 |
| 1121 | 1505 | MARC1-1953 | 22.0 | 2.9 | 35.2 | 10.0 |
| 1122 | 1506 | MARC1-1955 | 20.3 | 1.6 | 24.9 | 2.4 |
| 1123 | 1507 | MARC1-1981 | 24.8 | 1.4 | 24.5 | 2.3 |
| 1124 | 1508 | MARC1-1983 | 26.7 | 2.2 | 19.2 | 6.6 |
| 1125 | 1509 | MARC1-1985 | 41.5 | 2.2 | 16.4 | 2.5 |
| 1126 | 1510 | MARC1-1986 | 22.6 | 1.8 | 15.0 | 2.8 |
| 1127 | 1511 | MARC1-1988 | 35.6 | 4.6 | 63.9 | 24.7 |
| 1128 | 1512 | MARC1-1989 | 39.6 | 4.4 | 26.2 | 4.3 |
| 1129 | 1513 | MARC1-1990 | 25.8 | 1.9 | 18.8 | 2.2 |
| 1130 | 1514 | MARC1-1995 | 27.8 | 1.2 | 22.9 | 2.5 |
| 1131 | 1515 | MARC1-1996 | 36.0 | 2.3 | 19.7 | 2.0 |
| 1132 | 1516 | MARC1-1998 | 108.0 | 16.4 | 51.0 | 8.5 |
| 1133 | 1517 | MARC1-1999 | 57.4 | 4.9 | 74.3 | 12.0 |
| 1134 | 1518 | MARC1-2000 | 34.4 | 2.3 | 17.8 | 3.5 |
| 1135 | 1519 | MARC1-2001 | 53.6 | 7.9 | 17.9 | 3.0 |
| 1136 | 1520 | MARC1-2002 | 68.0 | 17.7 | 11.3 | 3.4 |
| 1137 | 1521 | MARC1-2005 | 27.4 | 5.7 | 34.1 | 12.2 |
| 1138 | 1522 | MARC1-2006 | 25.2 | 1.8 | 23.8 | 2.6 |
| 1139 | 1523 | MARC1-2010 | 63.5 | 7.7 | 33.0 | 4.5 |
| 1140 | 1524 | MARC1-2011 | 21.8 | 2.0 | 22.0 | 4.9 |
| 1141 | 1525 | MARC1-2012 | 19.1 | 1.2 | 9.9 | 1.0 |
| 1142 | 1526 | MARC1-2013 | 34.8 | 5.6 | 10.7 | 2.1 |
| 1143 | 1527 | MARC1-2015 | 93.3 | 24.0 | 23.5 | 6.8 |
| 1144 | 1528 | MARC1-2016 | 57.0 | 11.1 | 12.6 | 2.9 |
| 1145 | 1529 | MARC1-2017 | 24.8 | 1.2 | 25.3 | 2.0 |
| 1146 | 1530 | MARC1-2018 | 34.4 | 4.1 | 29.9 | 5.6 |
| 1147 | 1531 | MARC1-2019 | 25.5 | 2.6 | 22.4 | 2.5 |
| 1148 | 1532 | MARC1-2020 | 25.7 | 2.6 | 27.9 | 7.9 |
| 1149 | 1533 | MARC1-2022 | 18.5 | 1.5 | 18.4 | 2.6 |
| 1150 | 1534 | MARC1-2023 | 34.1 | 2.4 | 14.6 | 1.2 |
| 1151 | 1535 | MARC1-2025 | 137.2 | 22.1 | 24.1 | 4.8 |
| 1152 | 1536 | MARC1-2027 | 158.4 | 33.6 | 39.5 | 9.7 |

Example 3: RNAi Oligonucleotide Inhibition of MARC1 In Vivo

The in vitro screening assay in Example 2 validated the ability of MARC1-targeting oligonucleotides to knock-down target mRNA. To confirm the ability of the RNAi oligonucleotides to knockdown MARC1 in vivo, an HDI mouse model was used. A subset of the DsiRNAs identified in Example 2 were used to generate corresponding double-stranded RNAi oligonucleotides comprising a nicked tetraloop GalNAc-conjugated structure (referred to herein as "GalNAc-conjugated MARC1 oligonucleotides" or "GalNAc-MARC1 oligonucleotides") having a 36-mer passenger strand and a 22-mer guide strand (Table 4). Further, the nucleotide sequences comprising the passenger strand and guide strand have a distinct pattern of modified nucleotides and phosphorothioate linkages (sense strand SEQ ID Nos: 1609-1642; antisense SEQ ID Nos: 1645-1678). Three of the nucleotides comprising the tetraloop were each conjugated to a GalNAc moiety (CAS #14131-60-3). The modification pattern of each strand is illustrated below:

```
Sense Strand:
5'-mX-S-mX-mX-mX-mX-mX-mX-fX-fX-fX-fX[-mX-]16-

[ademX-GalNAc]-[ademX-GalNAc]-

[ademX-GalNAc]-mX-mX-mX-mX-mX-mX-3'.
```

Hybridized to:

```
Antisense Strand:
5'-[MePhosphonate-4O-mX]-S-fX-S-fX-S-fX-fX-mXfX-mX-mX-fX-mX-mX-mX-fX-mX-mX-mX-mX-mX-mX- S-mX-S-mX-3'.
```

Or, represented as:

```
Sense Strand:
[mXs][mX][mX][mX][mX][mX][mX][fX][fX][fX][fX]

[mX][mX][mX][mX][mX][mX][mX][mX][mX][mX][mX]

[mX][mX][mX][mX][ademA-GalNAc][ademA-

GalNAc][ademA-GalNAc][mX][mX][mX][mX][mX]
```

Hybridized to:

```
Antisense Strand:
[MePhosphonate-4O-mXs][fXs][fXs][fX][fX][mX]

[fX][mX][mX][fX][mX][mX][mX][fX][mX][mX][mX]

[mX][mX][mXs][mXs][mX]
```

TABLE 3

(Modification key:).

| Symbol | Modification/linkage |
|---|---|
| | Key 1 |
| mX | 2'-O-methyl modified nucleotide |
| fX | 2'-fluoro modified nucleotide |
| -S- | phosphorothioate linkage |
| — | phosphodiester linkage |
| [MePhosphonate-4O-mX] | 5'-methoxyphosphonate-4'-oxy modified nucleotide |
| ademA-GalNAc | GalNAc attached to an adenine nucleotide |
| | Key 2 |
| [mXs] | 2'-O-methyl modified nucleotide with a phosphorothioate linkage to the neighboring nucleotide |
| [fXs] | 2'-fluoro modified nucleotide with a phosphorothioate linkage to the neighboring nucleotide |

TABLE 3-continued (Modification key:).

| Symbol | Modification/linkage |
|---|---|
| [mX] | 2'-O-methyl modified nucleotide with phosphodiester linkages to neighboring nucleotides |
| [fX] | 2'-fluoro modified nucleotide with phosphodiester linkages to neighboring nucleotides |

Oligonucleotides in Table 4 were evaluated in mice engineered to transiently express human MARC1 mRNA in hepatocytes of the mouse liver. Briefly, 6-8-week-old female CD-1 mice (n=4-5) were subcutaneously administered the indicated GalNAc-conjugated MARC1 oligonucleotides at a dose of 2 mg/kg formulated in PBS. A control group of mice (n=5) were administered only PBS. Three days later (72 hours), the mice were HDI with a DNA plasmid encoding the full human MARC1 gene (SEQ ID NO: 1682) (25 μg) under control of a ubiquitous cytomegalovirus (CMV) promoter sequence. One day after introduction of the DNA plasmid, liver samples from HDI mice were collected. Total RNA derived from these HDI mice were subjected to qRT-PCR analysis to determine MARC1 mRNA levels as described in Example 2. mRNA levels were measured for human mRNA. The values were normalized for transfection efficiency using the NeoR gene included on the DNA plasmid.

TABLE 4

GalNAc-Conjugated MARC1 RNAi Oligonucleotides for HDI screen

| | Unmodified Sense Strand (SEQ ID NO) | Unmodified Antisense strand (SEQ ID NO) | Modified Sense Strand (SEQ ID NO) | Modified Antisense strand (SEQ ID NO) |
|---|---|---|---|---|
| MARC1-0324 | 1537 | 1573 | 1609 | 1645 |
| MARC1-0326 | 1538 | 1574 | 1610 | 1646 |
| MARC1-0327 | 1539 | 1575 | 1611 | 1647 |
| MARC1-0330 | 1540 | 1576 | 1612 | 1648 |
| MARC1-0331 | 1541 | 1577 | 1613 | 1649 |
| MARC1-0735 | 1542 | 1578 | 1614 | 1650 |
| MARC1-0736 | 1543 | 1579 | 1615 | 1651 |
| MARC1-0788 | 1544 | 1580 | 1616 | 1652 |
| MARC1-0863 | 1545 | 1581 | 1617 | 1653 |
| MARC1-1179 | 1546 | 1582 | 1618 | 1654 |
| MARC1-2012 | 1547 | 1583 | 1619 | 1655 |
| MARC1-2013 | 1548 | 1584 | 1620 | 1656 |
| MARC1-0661 | 1549 | 1585 | 1621 | 1657 |
| MARC1-1869 | 1550 | 1586 | 1622 | 1658 |
| MARC1-1876 | 1551 | 1587 | 1623 | 1659 |
| MARC1-1886 | 1552 | 1588 | 1624 | 1660 |
| MARC1-2016 | 1553 | 1589 | 1625 | 1661 |
| MARC1-0413 | 1554 | 1590 | 1626 | 1662 |
| MARC1-0416 | 1555 | 1591 | 1627 | 1663 |
| MARC1-0622 | 1556 | 1592 | 1628 | 1664 |
| MARC1-0638 | 1557 | 1593 | 1629 | 1665 |
| MARC1-0657 | 1558 | 1594 | 1630 | 1666 |
| MARC1-0660 | 1559 | 1595 | 1631 | 1667 |
| MARC1-0965 | 1560 | 1596 | 1632 | 1668 |
| MARC1-0966 | 1561 | 1597 | 1633 | 1669 |
| MARC1-0967 | 1562 | 1598 | 1634 | 1670 |
| MARC1-0969 | 1563 | 1599 | 1635 | 1671 |
| MARC1-1177 | 1564 | 1600 | 1636 | 1672 |
| MARC1-1884 | 1565 | 1601 | 1637 | 1673 |
| MARC1-1885 | 1566 | 1602 | 1638 | 1674 |
| MARC1-1955 | 1567 | 1603 | 1639 | 1675 |
| MARC1-1983 | 1568 | 1604 | 1640 | 1676 |

TABLE 4-continued

GalNAc-Conjugated MARC1 RNAi
Oligonucleotides for HDI screen

| | Unmodified Sense Strand (SEQ ID NO) | Unmodified Antisense strand (SEQ ID NO) | Modified Sense Strand (SEQ ID NO) | Modified Antisense strand (SEQ ID NO) |
|---|---|---|---|---|
| MARC1-1986 | 1569 | 1605 | 1641 | 1677 |
| MARC1-2011 | 1570 | 1606 | 1642 | 1678 |

Figure 2:
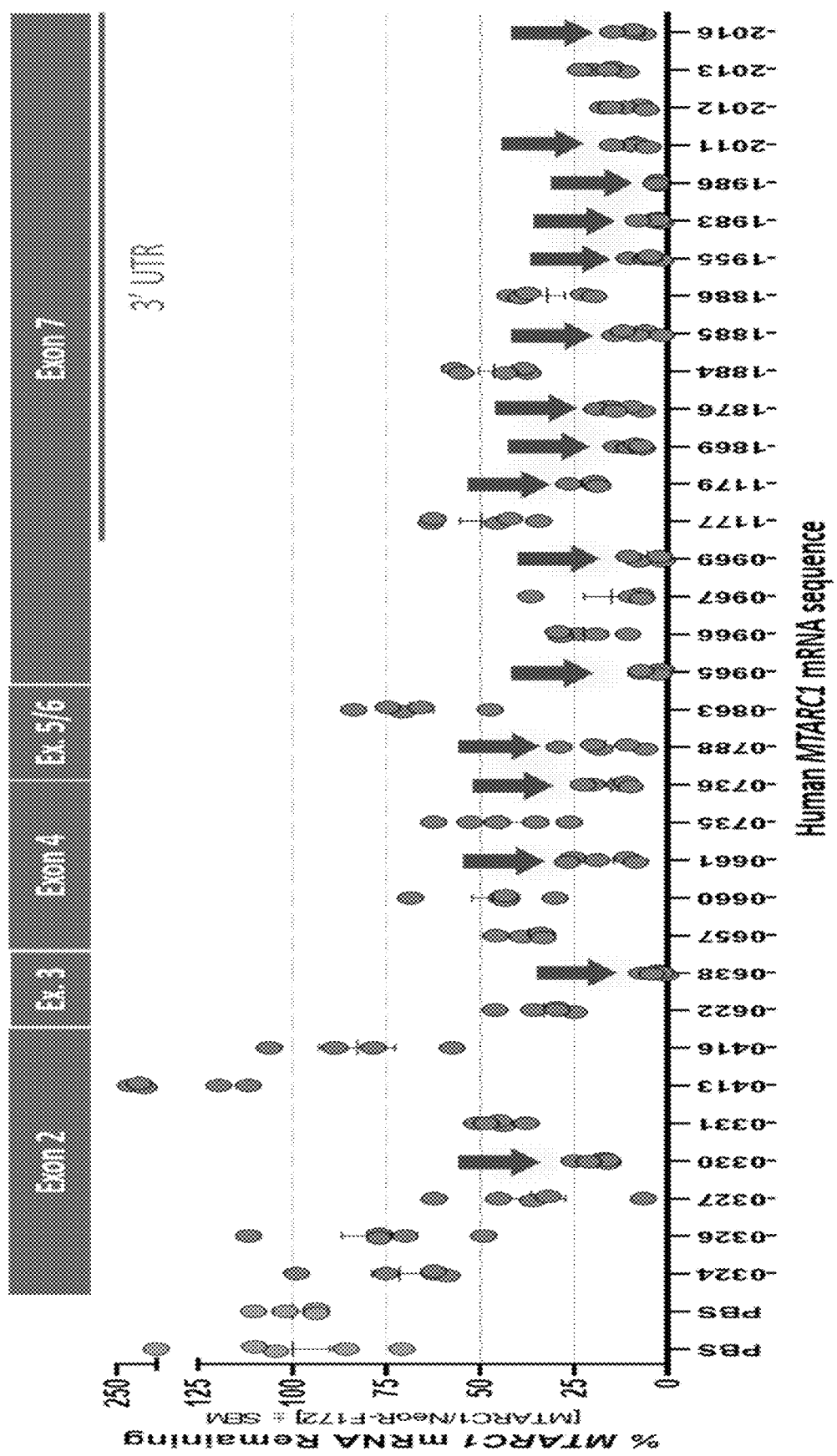
FIG. 2 provides a graph depicting the percent (%) of human MARC1 mRNA remaining in the liver of mice exogenously expressing human MARC1 (hydrodynamic injection model) after treatment with GalNAc-conjugated MARC1 oligonucleotides. Mice were dosed subcutaneously with 2 mg/kg of the indicated GalNAc-MARC1 oligonucleotides formulated in phosphate buffered saline (PBS). Three days post-dose mice were hydrodynamically injected (HDI) with a DNA plasmid encoding human MARC1. The level of human MARC1 mRNA was determined from livers collected after 18 hours. Arrows indicate oligonucleotides selected for validation.

The results in FIG. 2 demonstrate that GalNAc-conjugated MARC1 oligonucleotides designed to target human MARC1 mRNA inhibited human MARC1 mRNA expression in HDI mice, as determined by a reduction in the amount of human MARC1 mRNA expression in liver samples from HDI mice treated with GalNAc-conjugated MARC1 oligonucleotides relative to control HDI mice treated with only PBS.

Figure 3:
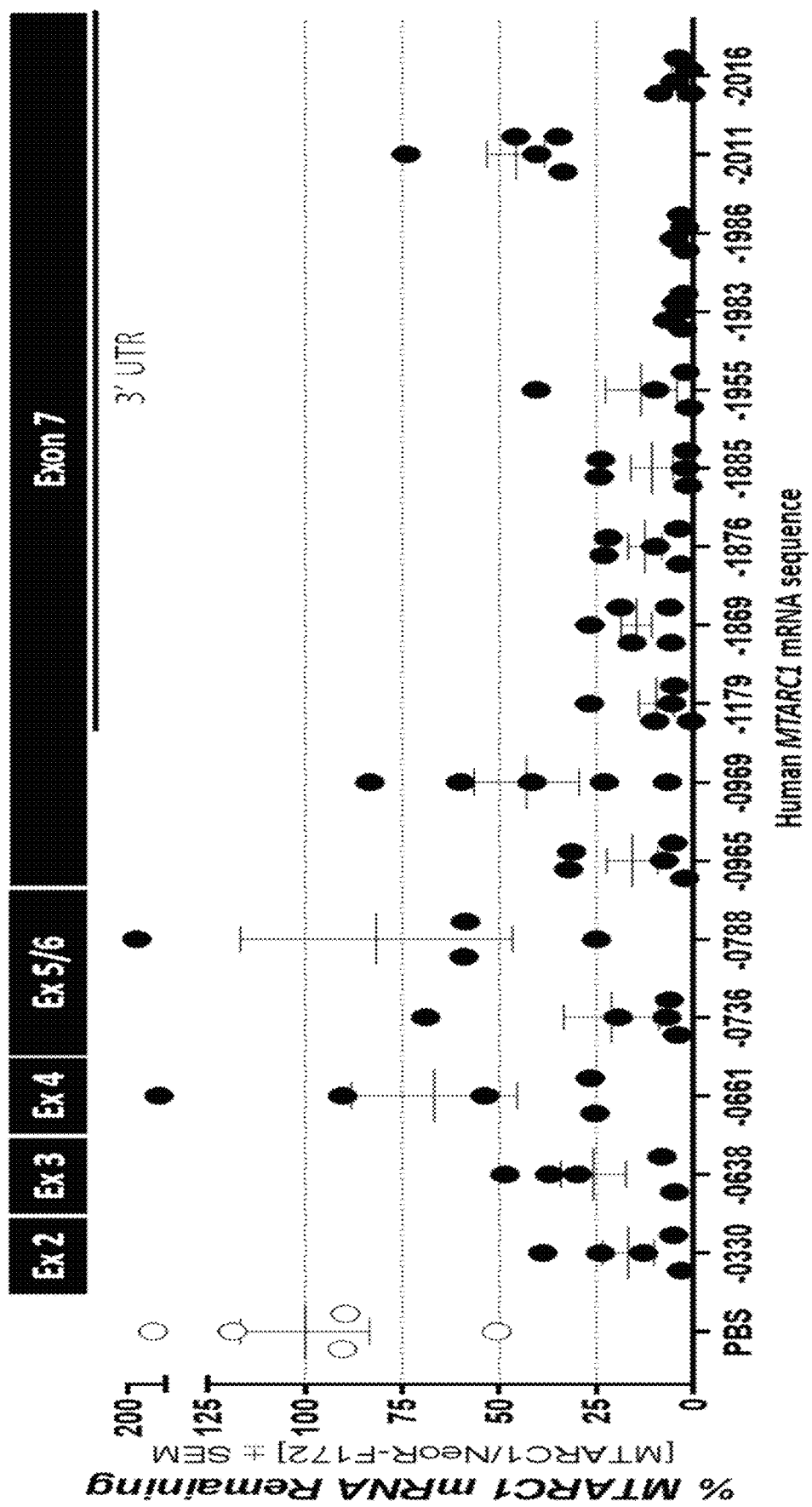
FIG. 3 provides a graph depicting the percent (%) of human MARC1 mRNA remaining in the liver of mice exogenously expressing human MARC1 (hydrodynamic injection model) after treatment with human GalNAc-conjugated MARC1 oligonucleotides selected for validation based on the results in FIG. 2 Mice were dosed subcutaneously with 2 mg/kg of the indicated GalNAc-MARC1 oligonucleotides formulated in PBS. Three days post-dose mice were HDI with a DNA plasmid encoding MARC1. The level of human MARC1 mRNA was determined from livers collected 18 hours later.

A subset of the GalNAc-conjugated MARC1 oligonucleotides tested in FIG. 2 were further validated in repeat assays as shown in FIG. 3 using oligonucleotides selected from Table 4. The assays verified knock-down efficiency of each GalNAc-conjugated MARC1 oligonucleotide, and four oligonucleotides were selected for further analysis.

Figure 4:
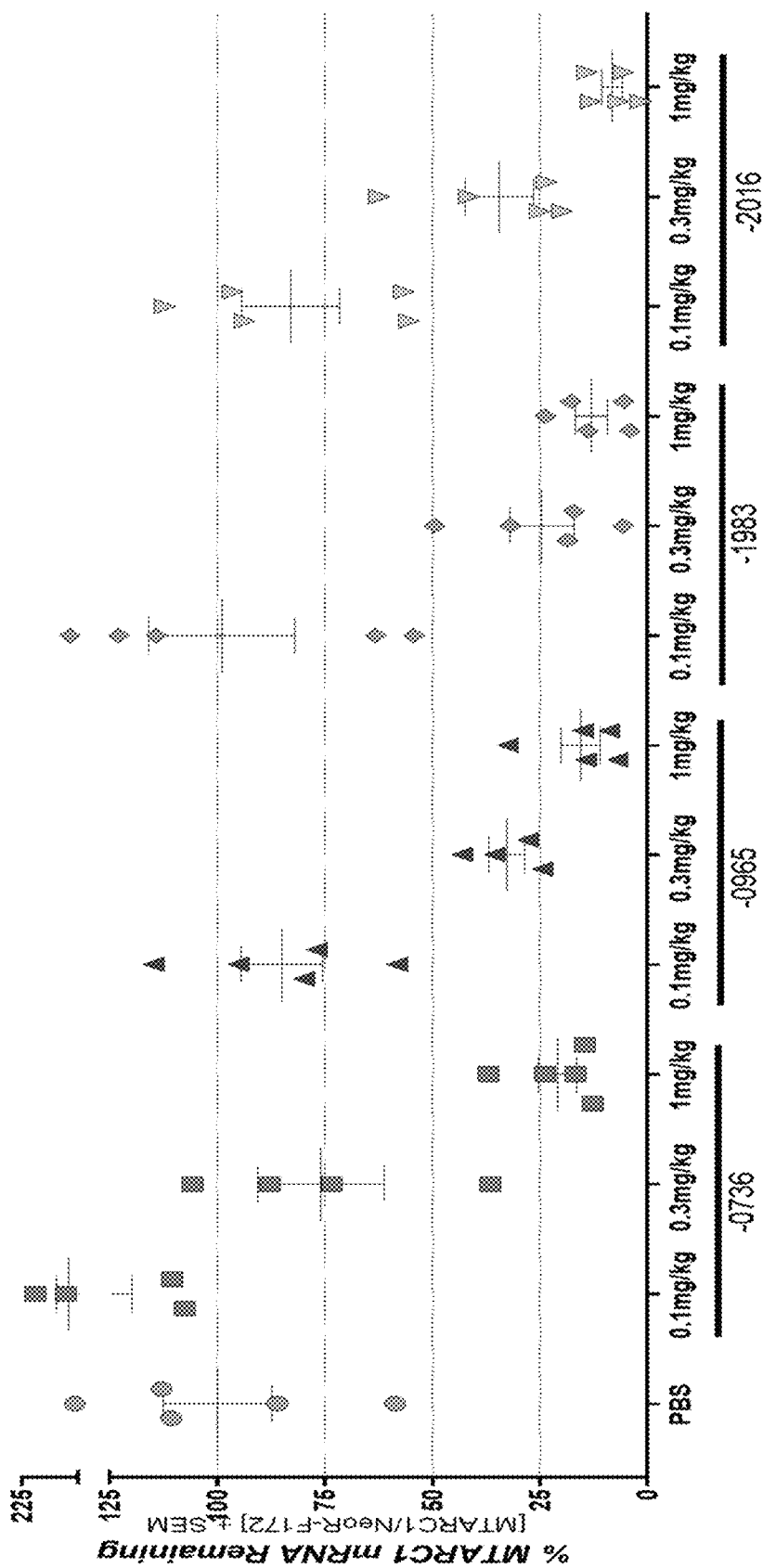
FIG. 4 provides a graph depicting the dose response of GalNAc-conjugated MARC1 oligonucleotides selected for NHP studies. The percent (%) of human MARC1 mRNA remaining in the liver of mice exogenously expressing human MARC1 (hydrodynamic injection model) after treatment with human GalNAc-conjugated MARC1 oligonucleotides at three doses (0.1 mg/kg, 0.3 mg/kg, and 1 mg/kg) was measured. Three days post-dose mice were HDI with a DNA plasmid encoding MARC1. The level of human MARC1 mRNA was determined from livers collected 18 hours later.

Specifically, dosing studies were carried out using four GalNAc-conjugated MARC1 oligonucleotides (MARC1-0736, MARC1-965, MARC1-1983, and MARC1-2016). Mice were HDI as described above and treated with 0.1 mg/kg, 0.3 mg/kg, or 1 mg/kg of oligonucleotide. Livers were collected after one day, and MARC1 expression was measured to determine a potent dose (FIG. 4). All GalNAc-conjugated MARC1 oligonucleotides were able to reduce MARC1 expression at a 1 mg/kg dose. Overall, the HDI studies identified several potential GalNAc-conjugated MARC1 oligonucleotides for inhibiting MARC1 expression in liver.

Example 4: RNAi Oligonucleotide Inhibition of MARC1 in DIO-NASH Disease Model

To investigate the therapeutic effect of GalNAc-conjugated MARC1 oligonucleotides on liver diseases such as NAFLD and NASH, the diet-induced obese (DIO)-NASH model was used (Kristiansen, M., et al. 2016. *WJH*. 8(16): 673-684). The model exhibits histopathology and clinical endpoints similar to NASH and is initiated through a diet high in fat, fructose, and cholesterol. Two mice specific surrogate GalNAc-conjugated MARC1 oligonucleotides with different levels of knockdown (Table 5B) were tested in this murine model of NASH. Mice were fed Lean Chow (11% fat, 24% protein, and 65% carbohydrate; Altromin 1324, Brogaarden, Denmark), or a NASH diet consisting of 40% fat, 22% fructose and 2% cholesterol (D09100310, Research Diets) for 36 weeks (DIO-NASH). Prior to treatment with oligonucleotides and the GLP-1 receptor agonist mice were randomized into chow control, PBS control, GLP-1 '22', MARC1-1113 (SEQ ID NOs: 1643 and 1679), and MARC1-1575 (SEQ ID NOs: 1644 and 1680) treatment groups by their fibrosis state as determined by Colla1, i.e., collagen, levels (data not shown). Weekly concurrent, subcutaneous dosing was initiated on week 36 and mice were treated with 3 mg/kg of MARC1-1113, 3 mg/kg of MARC1-1575, 10 nmol/kg of GLP-1 '22', or PBS control ("DIO-NASH vehicle") for 8 weeks. The GLP-1 receptor agonist (GLP-1 '22') is a long acting GLP-1 receptor agonist and used as a benchmark in these studies. Injections were given on days 0, 7, 14, 21, 28, 35, 42, and 49 after initiation of the study (i.e. week 36 on DIO-NASH or Lean Chow diet). The DIO-NASH vehicle control, MARC1-1113, and MARC1-1575 mice increased their relative body weight at similar pace throughout the duration of the study (Table 5A). As expected, the Lean-Chow showed a slower rate of body weight gain, while GLP-1 '22' controls showed a reduction in relative body weight to the start of the study.

Table 5A provides the body weight of mice throughout treatment with GalNAc-conjugated MARC1 oligonucleotides targeting mouse MARC1 or a long acting GLP-1 receptor against (GLP-1 '22') used as positive control for disease regression in a diet induced obesity (DIO)-NASH model. Weights are relative to starting weight. Mice were fed a DIO-NASH (AMLN diet) or Lean-Chow diet.

| | Body Weight (%) | | | | | | | | | |
|---|---|---|---|---|---|---|---|---|---|---|
| Study | Lean-Chow | | DIO-NASH Vehicle | | MARC1-1113 | | MARC1-1575 | | GLP-1 '22' | |
| Day | Mean | SEM | Mean | SEM | Mean | SEM | Mean | SEM | Mean | SEM |
| −4 | 101.02 | 0.48 | 99.86 | 0.56 | 99.13 | 0.33 | 100.18 | 0.39 | 99.91 | 0.50 |
| −3 | 100.79 | 0.53 | 99.95 | 0.50 | 98.73 | 0.28 | 100.20 | 0.37 | 99.39 | 0.49 |
| −2 | 100.75 | 0.38 | 99.74 | 0.41 | 98.96 | 0.37 | 99.75 | 0.32 | 99.16 | 0.45 |
| −1 | 100.52 | 0.31 | 99.74 | 0.25 | 99.10 | 0.25 | 99.74 | 0.31 | 99.33 | 0.33 |
| 0 | 100.00 | 0.00 | 100.00 | 0.00 | 100.00 | 0.00 | 100.00 | 0.00 | 100.00 | 0.00 |
| 1 | 99.46 | 0.50 | 100.13 | 0.30 | 99.28 | 0.24 | 99.72 | 0.33 | 98.23 | 0.35 |
| 2 | 99.66 | 0.34 | 100.10 | 0.30 | 99.42 | 0.25 | 99.72 | 0.47 | 96.88 | 0.39 |
| 3 | 99.77 | 0.44 | 100.81 | 0.37 | 99.61 | 0.28 | 100.59 | 0.37 | 95.46 | 0.47 |
| 4 | 100.11 | 0.41 | 101.09 | 0.42 | 100.34 | 0.25 | 101.18 | 0.47 | 92.30 | 0.64 |
| 5 | 100.38 | 0.61 | 100.99 | 0.40 | 100.04 | 0.39 | 100.80 | 0.52 | 89.71 | 0.69 |
| 6 | 100.87 | 0.58 | 101.24 | 0.48 | 99.92 | 0.49 | 101.04 | 0.56 | 86.62 | 0.84 |
| 7 | 101.37 | 0.55 | 101.86 | 0.56 | 100.52 | 0.54 | 101.65 | 0.56 | 86.13 | 1.09 |
| 8 | 101.31 | 0.55 | 101.82 | 0.55 | 101.14 | 0.40 | 102.28 | 0.56 | 84.75 | 1.50 |
| 9 | 101.10 | 0.70 | 102.34 | 0.71 | 101.90 | 0.51 | 102.28 | 0.63 | 83.78 | 1.76 |
| 10 | 101.60 | 0.73 | 102.75 | 0.61 | 102.57 | 0.56 | 103.09 | 0.63 | 84.31 | 1.65 |
| 11 | 101.63 | 0.88 | 102.88 | 0.68 | 102.74 | 0.57 | 103.45 | 0.76 | 84.25 | 1.54 |
| 12 | 101.50 | 0.82 | 102.71 | 0.67 | 102.47 | 0.51 | 103.01 | 0.81 | 83.92 | 1.51 |
| 13 | 101.30 | 0.79 | 102.66 | 0.61 | 102.45 | 0.66 | 101.92 | 0.60 | 83.88 | 1.27 |
| 14 | 101.38 | 0.69 | 103.13 | 0.68 | 102.37 | 0.54 | 104.19 | 0.85 | 83.46 | 1.35 |
| 15 | 100.75 | 0.79 | 102.89 | 0.64 | 102.52 | 0.72 | 103.85 | 0.83 | 83.39 | 1.37 |
| 16 | 101.63 | 1.18 | 102.47 | 0.67 | 102.34 | 0.70 | 103.58 | 0.86 | 83.39 | 1.26 |

Body Weight (%)

| Study Day | Lean-Chow Mean | SEM | DIO-NASH Vehicle Mean | SEM | MARC1-1113 Mean | SEM | MARC1-1575 Mean | SEM | GLP-1 '22' Mean | SEM |
|---|---|---|---|---|---|---|---|---|---|---|
| 17 | 102.92 | 0.88 | 103.49 | 0.65 | 102.98 | 0.66 | 104.44 | 0.85 | 82.71 | 1.31 |
| 18 | 103.67 | 1.08 | 103.61 | 0.66 | 102.97 | 0.76 | 104.75 | 0.85 | 82.51 | 1.41 |
| 19 | 103.62 | 0.94 | 103.69 | 0.64 | 103.10 | 0.68 | 104.75 | 0.88 | 82.12 | 1.45 |
| 20 | 102.89 | 0.73 | 103.65 | 0.63 | 103.29 | 0.82 | 105.00 | 0.89 | 81.96 | 1.20 |
| 21 | 102.36 | 0.95 | 103.73 | 0.73 | 103.76 | 0.86 | 105.52 | 0.89 | 82.52 | 1.02 |
| 22 | 101.94 | 0.96 | 104.69 | 0.56 | 103.86 | 0.82 | 105.45 | 0.79 | 82.74 | 1.03 |
| 23 | 102.50 | 0.93 | 104.39 | 0.58 | 103.61 | 0.80 | 105.32 | 0.71 | 83.14 | 1.02 |
| 24 | 103.73 | 1.07 | 104.71 | 0.85 | 104.19 | 0.73 | 106.05 | 0.82 | 82.30 | 1.05 |
| 25 | 102.48 | 0.75 | 103.46 | 0.72 | 103.92 | 0.73 | 106.28 | 0.69 | 82.66 | 1.02 |
| 26 | 101.93 | 0.95 | 103.08 | 0.79 | 103.56 | 0.76 | 105.30 | 0.74 | 82.37 | 0.98 |
| 27 | 102.19 | 0.80 | 102.52 | 0.79 | 102.83 | 0.62 | 104.33 | 0.87 | 81.69 | 0.94 |
| 28 | 101.51 | 0.74 | 103.28 | 0.77 | 102.98 | 0.66 | 104.89 | 0.90 | 82.04 | 0.86 |
| 29 | 101.95 | 0.76 | 103.24 | 0.75 | 103.38 | 0.82 | 104.34 | 0.96 | 82.26 | 0.94 |
| 30 | 102.50 | 0.75 | 103.89 | 0.78 | 104.13 | 0.81 | 105.52 | 0.96 | 82.09 | 0.93 |
| 31 | 102.80 | 0.65 | 103.38 | 0.73 | 103.80 | 0.90 | 105.25 | 0.84 | 81.99 | 0.96 |
| 32 | 102.83 | 0.59 | 104.30 | 0.84 | 104.40 | 0.77 | 105.67 | 0.88 | 82.49 | 0.89 |
| 33 | 102.03 | 0.80 | 104.44 | 0.94 | 104.52 | 0.71 | 105.65 | 0.97 | 82.35 | 0.85 |
| 34 | 102.69 | 0.89 | 104.26 | 0.91 | 104.13 | 0.76 | 105.25 | 1.02 | 81.87 | 0.83 |
| 35 | 102.08 | 0.93 | 104.79 | 0.92 | 104.93 | 0.75 | 105.20 | 0.82 | 82.25 | 0.87 |
| 36 | 102.37 | 0.75 | 105.56 | 0.96 | 106.31 | 0.73 | 107.05 | 0.78 | 83.11 | 0.85 |
| 37 | 102.12 | 1.02 | 105.43 | 0.91 | 106.24 | 0.84 | 106.24 | 0.91 | 81.99 | 0.86 |
| 38 | 101.59 | 0.67 | 105.11 | 0.96 | 106.36 | 0.80 | 106.94 | 0.78 | 82.54 | 0.92 |
| 39 | 102.70 | 0.68 | 105.38 | 0.94 | 106.37 | 0.81 | 107.12 | 0.90 | 82.73 | 1.06 |
| 40 | 101.56 | 0.87 | 105.64 | 1.09 | 106.83 | 0.88 | 107.44 | 0.79 | 82.70 | 1.05 |
| 41 | 101.72 | 0.78 | 105.93 | 1.17 | 106.36 | 0.96 | 107.19 | 0.75 | 82.86 | 0.89 |
| 42 | 101.61 | 1.01 | 106.56 | 1.14 | 106.20 | 0.95 | 106.85 | 0.84 | 82.14 | 0.97 |
| 43 | 101.40 | 1.05 | 107.48 | 1.12 | 107.12 | 0.90 | 108.24 | 0.87 | 82.88 | 0.93 |
| 44 | 102.44 | 0.89 | 107.39 | 1.11 | 106.59 | 0.81 | 107.73 | 0.88 | 82.56 | 1.01 |
| 45 | 102.32 | 0.90 | 106.94 | 1.07 | 106.76 | 0.86 | 107.73 | 1.04 | 82.44 | 1.16 |
| 46 | 101.98 | 1.22 | 106.96 | 1.26 | 107.00 | 0.91 | 107.79 | 0.99 | 82.91 | 1.14 |
| 47 | 102.43 | 1.09 | 107.36 | 1.33 | 107.18 | 0.98 | 108.15 | 0.98 | 82.76 | 1.12 |
| 48 | 102.28 | 0.77 | 107.51 | 1.32 | 107.36 | 0.88 | 108.50 | 1.07 | 83.12 | 1.18 |
| 49 | 103.32 | 1.02 | 107.94 | 1.14 | 107.82 | 0.94 | 108.40 | 1.09 | 82.35 | 1.05 |
| 50 | 102.74 | 0.95 | 108.53 | 1.14 | 108.70 | 0.74 | 107.63 | 1.09 | 82.91 | 1.09 |
| 51 | 103.84 | 1.11 | 108.51 | 1.39 | 108.46 | 0.92 | 108.05 | 0.96 | 83.41 | 1.01 |
| 52 | 103.49 | 1.27 | 108.86 | 1.28 | 109.03 | 0.79 | 108.28 | 0.88 | 83.14 | 1.03 |
| 53 | 102.83 | 0.89 | 109.09 | 1.30 | 109.06 | 0.72 | 108.15 | 1.06 | 83.33 | 1.10 |
| 54 | 101.77 | 1.30 | 108.67 | 1.32 | 108.76 | 0.77 | 108.41 | 1.11 | 82.31 | 1.24 |
| 55 | 102.81 | 0.95 | 109.63 | 1.23 | 109.77 | 0.70 | 109.05 | 1.19 | 83.46 | 1.26 |
| 56 | 103.33 | 0.95 | 109.84 | 1.31 | 110.04 | 0.83 | 109.29 | 1.04 | 83.57 | 1.23 |

Figure 5:
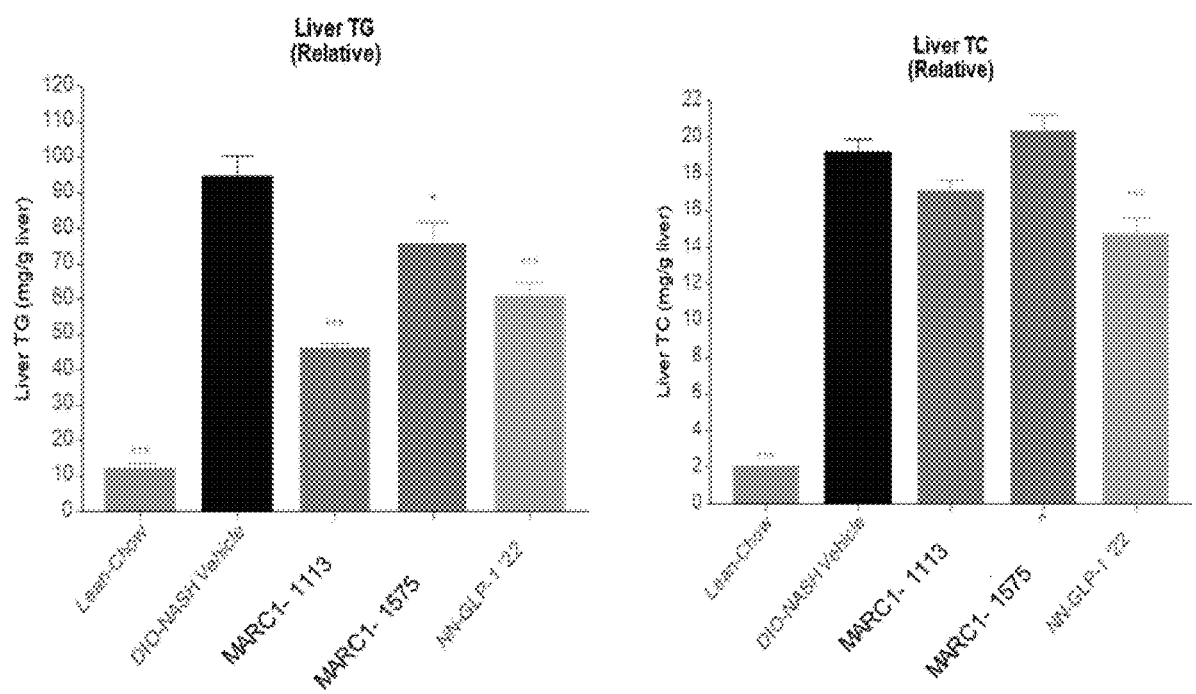
FIG. 5 and FIG. 6 provide graphs depicting the level of liver triglycerides (TG) and total cholesterol (TC) in samples collected on day 56 from mice fed a DIO-NASH diet or Lean Chow diet and treated with 8 weekly doses of the indicated GalNAc-conjugated MARC1 oligonucleotides (3 mg/kg) or control GLP-1 peptide (Jesper Lau et la. *J. Med. Chem.* (2015); 58, 7370-80, compound 22) (GLP-1 '22') (10 nmol/kg) relative to mice treated with PBS. Relative (FIG. 5) and total (FIG. 6) TG and TC levels were compared to DIO-NASH vehicle control. ***=p<0.001, *=p<0.05.
Figure 6:
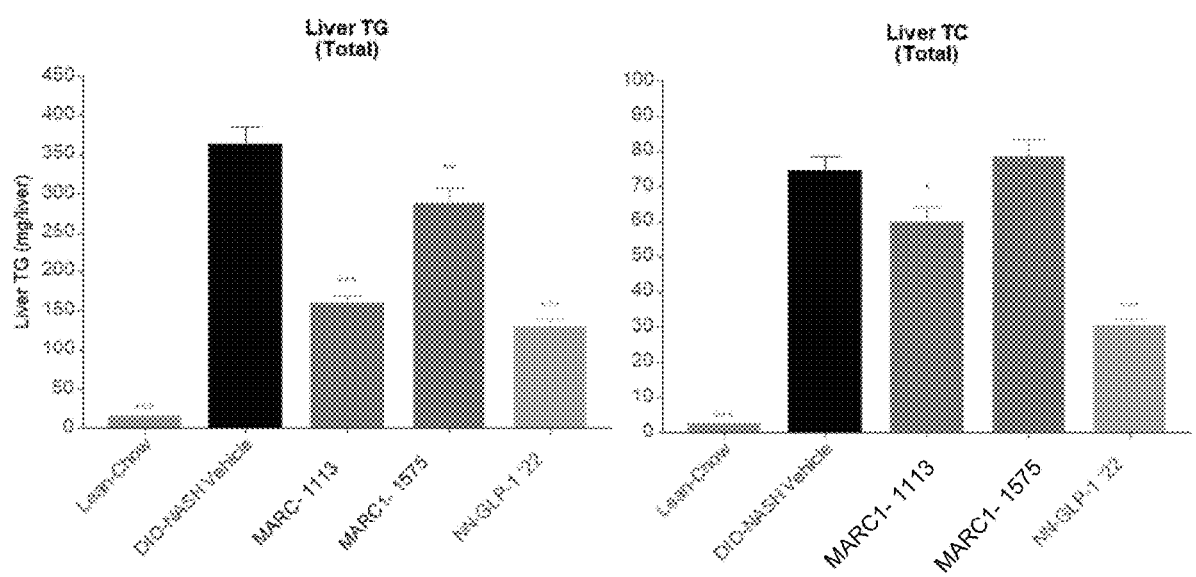
Figure 7:
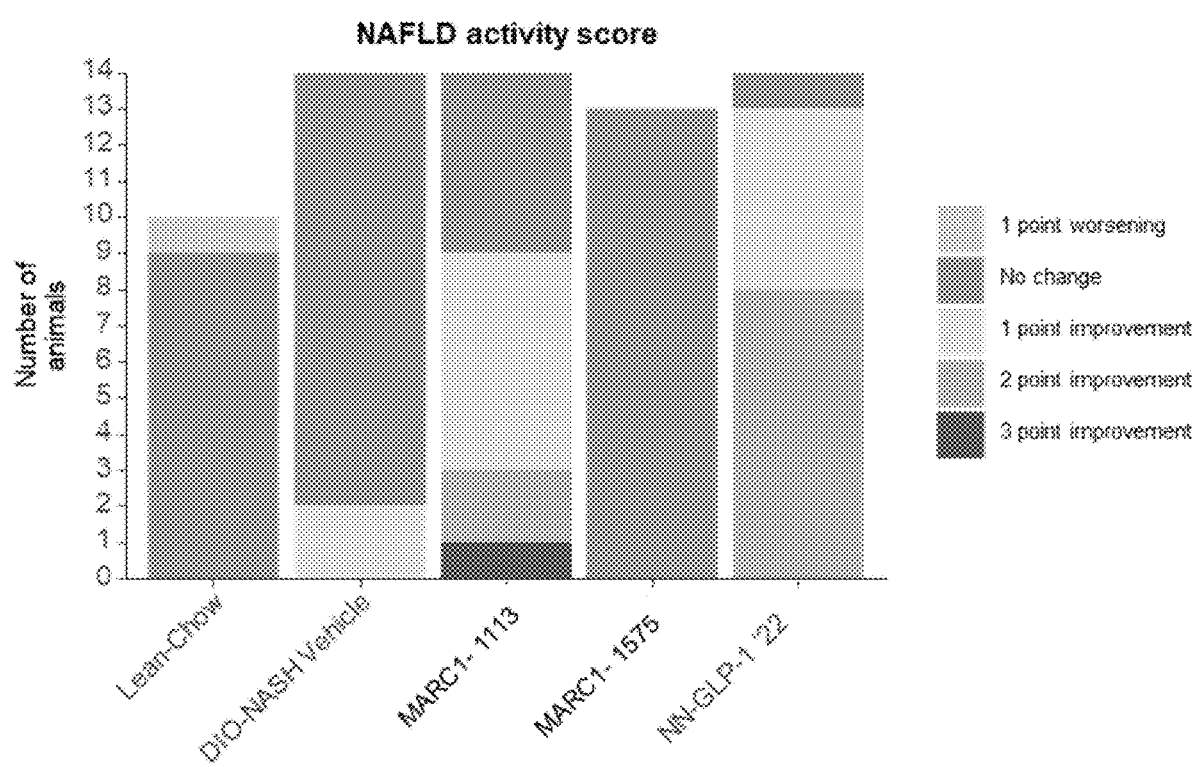
FIG. 7 provides a graph depicting NAFLD activity score in samples from mice fed a DIO-NASH diet or Lean Chow diet and treated with 8 weekly doses of the indicated GalNAc-conjugated MARC1 oligonucleotides (3 mg/kg) or GLP-1 '22' (10 nmol/kg) as control relative to mice treated with PBS. The score was calculated based on the NAFLD score at the end of the study.
Figure 8:
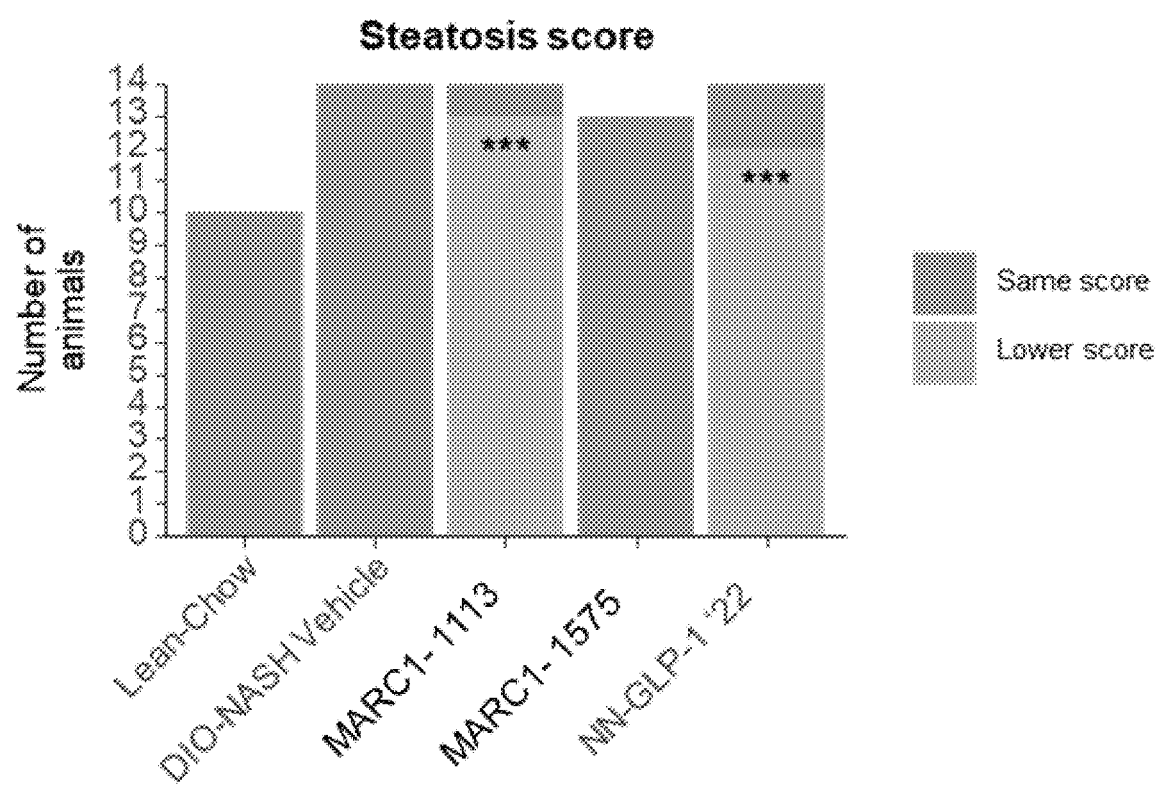
FIG. 8 provides a graph depicting the Steatosis Score in samples from mice fed a DIO-NASH diet or Lean Chow diet and treated with 8 weekly doses of the indicated GalNAc-conjugated MARC1 oligonucleotides (3 mg/kg) or GLP-1 '22' (10 nmol/kg) relative to mice treated with PBS. The score was calculated based on the Steatosis score at the end of the study.
Figure 9A:
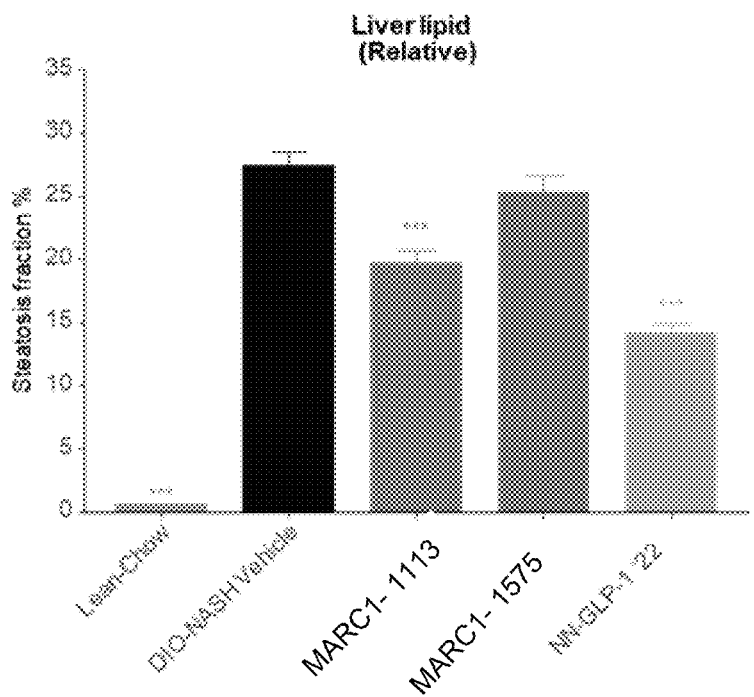
FIGS. 9A and 9B provide graphs quantifying the steatosis fraction (i.e. the percent (%) of liver steatosis in a given area) (FIG. 9A) and the percent (%) hepatocytes with lipid droplets (FIG. 9B) from mice fed a DIO-NASH diet or Lean Chow diet and treated with 8 weekly doses of the indicated GalNAc-conjugated MARC1 oligonucleotides, (10 nmol/kg) (3 mg/kg), or PBS. ***=p<0.001(relative to DIO-NASH vehicle treatment).
Figure 9B:
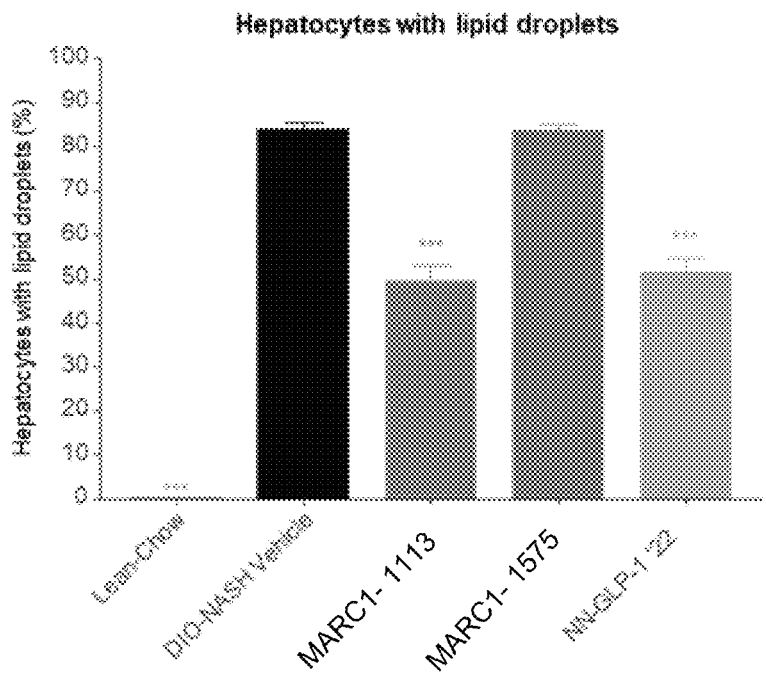
Figure 10:
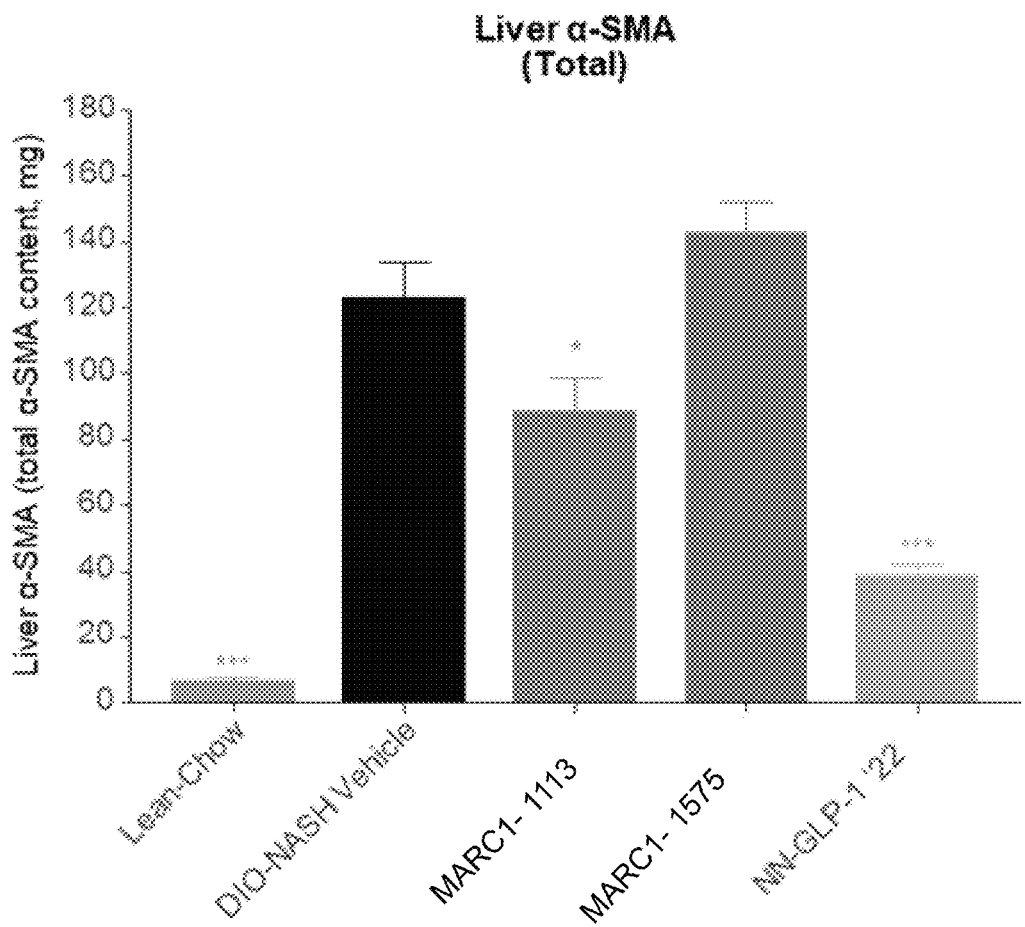
FIG. 10 provides a graph depicting α-SMA levels in liver samples from mice fed a DIO-NASH diet and treated with the indicated GalNAc-conjugated MARC1 oligonucleotides, (10 nmol/kg) PBS, or fed a Lean-Chow diet. ***=p<0.001, *=p<0.05 (relative to DIO-NASH vehicle treatment).

After week 8 of dosing, plasma was collected and analyzed for plasma alanine aminotransferase (ALT), aspartate aminotransferase (AST), triglyceride (TG), and total cholesterol (TC). The model performed as expected, as measured by the GLP-1 '22' control reducing ALT, AST, and TC levels. Treatment of DIO-NASH mice with the GalNAc-conjugated MARC1 oligonucleotides did not change the plasma ALT, AST, TG, or TC levels compared to PBS treated DIO-NASH mice (data not shown). Liver tissue was collected at week 8, weighed and processed for analysis. As expected, liver weight was lower in both Lean Chow mice and DIO-NASH mice treated with GLP-1 '22' at termination of the study compared to the NASH vehicle group. However, there was no observed difference in liver weight in the DIO-NASH mice treated with vehicle control or the GalNAc-conjugated MARC1 oligonucleotides (data not shown). In the liver, TG levels were reduced in both MARC1-1113 and MARC1-1575 treated mice compared to DIO-NASH vehicle control (FIGS. 5 and 6). Further, NAFLD activity was measured. The NAFLD activity score is used to measure changes in disease features concurrent with treatment for NAFLD and is measured by staining liver samples and using clinical criteria outlined in Kleiner et al. (Kleiner et al. 2005. Hepatology. 41: 1313-1321) to determine the score. The MARC1-1113 oligonucleotide demonstrated an improved NAFLD score in the DIO-NASH model (FIG. 7). Similarly, treatment with the MARC1-1113 oligonucleotide reduced steatosis (calculated as a percentage of hepatocytes with lipid droplets) in the animals (FIG. 8), but no reduction was observed for hepatocellular ballooning or lobular inflammation (data not shown) as determined by histopathological analysis as described in Kleiner et al. Reduced steatosis fraction (i.e. measured area fraction of steatosis in a histology sample) and hepatocytes with liver droplets is observed in MARC1-1113 treated mice, as determined by quantification of histopathological analysis using methods described in Kleiner et al. (FIGS. 9A and 9B). Inflammation and fibrosis do not appear to be changed with treatment as there was no observed difference in the number of inflammatory cells, inflammatory foci, CD45, CD11b, fibrosis, periportal fibrosis, sinusoidal fibrosis, or Col1a among treatment groups (data not shown). However, the stellate cell activation marker α-SMA, an early indicator of hepatic fibrosis was reduced by MARC1-1113 treatment demonstrating that although a reduction in overall fibrosis was not observed, treatment with MARC1-1113 reduced fibrosis development (FIG. 10). Finally, qPCR was performed on a panel of genes related to MARC1 expression, steatosis, cholesterol metabolism, fibrosis, phosphatidylcholine, and potential biomarkers (Table 5B). Reduced expression was observed for several steatosis relevant genes: Fasn, AcacA, AcacB, and ApoB, following MARC1-1113 treatment. Additionally, a reduction in several early regulators of fibrosis and potential biomarker genes were also reduced following MARC1-1113 treatment including: Col1a1, Tgfb, Timp1, Mmp9, Mmp2, and Fabp1. These findings demonstrate that MARC1 inhibition reduces genes that regulate steatosis and fibrosis development.

In conclusion, the DIO-NASH study demonstrates the therapeutic effect of hepatic MARC1 inhibition using GalNAc-conjugated MARC1 oligonucleotides.

with a comparable volume of PBS. To normalize the data, the measurements were made relative to the reference gene, PPIB. The following SYBR assays purchased from IDT were used to evaluate MARC1 gene expression: Forward-SEQ ID NO: 1690, Reverse-SEQ ID NO: 1691. The following TaqMan qPCR probe purchased from ThermoFisher Scientific, was used to evaluate PPIB gene expression: Rh02802984_m1. Treating NHPs with the GalNAc-conjugated MARC1 oligonucleotides listed in Table 6 inhibited MARC1 expression in the liver, as determined by a reduced

TABLE 5B

Summary of Gene Expression in MARC1 treated DIO-NASH Mice

| | | Mean % mRNA Remaining (Relative to DIO-NASH Vehicle) | | | | |
|---|---|---|---|---|---|---|
| | Gene | Lean-Chow | DIO-NASH Vehicle | MARC1-1113 | MARC1-1575 | GLP-1 '22' |
| Target-Related Genes | Marc1 | 140.38 | 100.00 | 10.61 | 30.60 | 114.18 |
| | Marc2 | 131.34 | 100.00 | 86.09 | 114.58 | 117.14 |
| | Nr1h3 | 108.41 | 100.00 | 92.01 | 118.46 | 111.44 |
| | Nr1h2 | 108.56 | 100.00 | 94.98 | 124.83 | 114.30 |
| | Fmo3 | 311.16 | 100.00 | 119.93 | 172.15 | 251.50 |
| | Dgat2 | 145.27 | 100.00 | 92.25 | 127.87 | 120.47 |
| Steatosis-Related Genes | Fasn | 172.84 | 100.00 | 67.93 | 132.57 | 173.23 |
| | Cidec | 3.45 | 100.00 | 92.15 | 138.33 | 65.26 |
| | Acc1 (AcacA) | 107.88 | 100.00 | 92.85 | 138.20 | 117.28 |
| | Acc2 (AcacB) | 158.79 | 100.00 | 59.13 | 102.16 | 144.66 |
| | Sdc1 | 115.80 | 100.00 | 99.88 | 119.66 | 118.81 |
| | ApoB | 88.84 | 100.00 | 78.57 | 97.86 | 97.60 |
| Cholesterol Metabolism-Related Genes | Abca1 | 83.94 | 100.00 | 99.39 | 130.12 | 110.81 |
| | Abcg5 | 28.58 | 100.00 | 90.89 | 96.52 | 95.70 |
| | Hmgcr | 562.47 | 100.00 | 84.95 | 146.22 | 157.49 |
| Phosphatidylcholine Hypothesis | Pemt | 160.40 | 100.00 | 86.47 | 115.15 | 115.73 |
| Early Regulators of Fibrosis Genes | Col1a1 | 9.02 | 100.00 | 57.83 | 142.74 | 58.97 |
| | Tgfb1 | 59.54 | 100.00 | 84.72 | 120.06 | 85.16 |
| | Timp1 | 3.02 | 100.00 | 49.32 | 136.88 | 48.32 |
| | Mmp9 | 104.95 | 100.00 | 68.95 | 99.70 | 99.41 |
| | Mmp2 | 20.57 | 100.00 | 81.04 | 174.74 | 124.65 |
| Biomarker Genes | pla2g12b | 120.28 | 100.00 | 92.93 | 124.68 | 102.55 |
| | Cpm | 136.88 | 100.00 | 122.37 | 140.68 | 125.86 |
| | Fabp1 | 128.78 | 100.00 | 82.50 | 176.75 | 216.97 |
| | Smpd1 | 107.65 | 100.00 | 95.05 | 121.59 | 115.48 |
| | Cyp7a1 | 75.08 | 100.00 | 126.34 | 120.64 | 121.09 |

Figure 11:
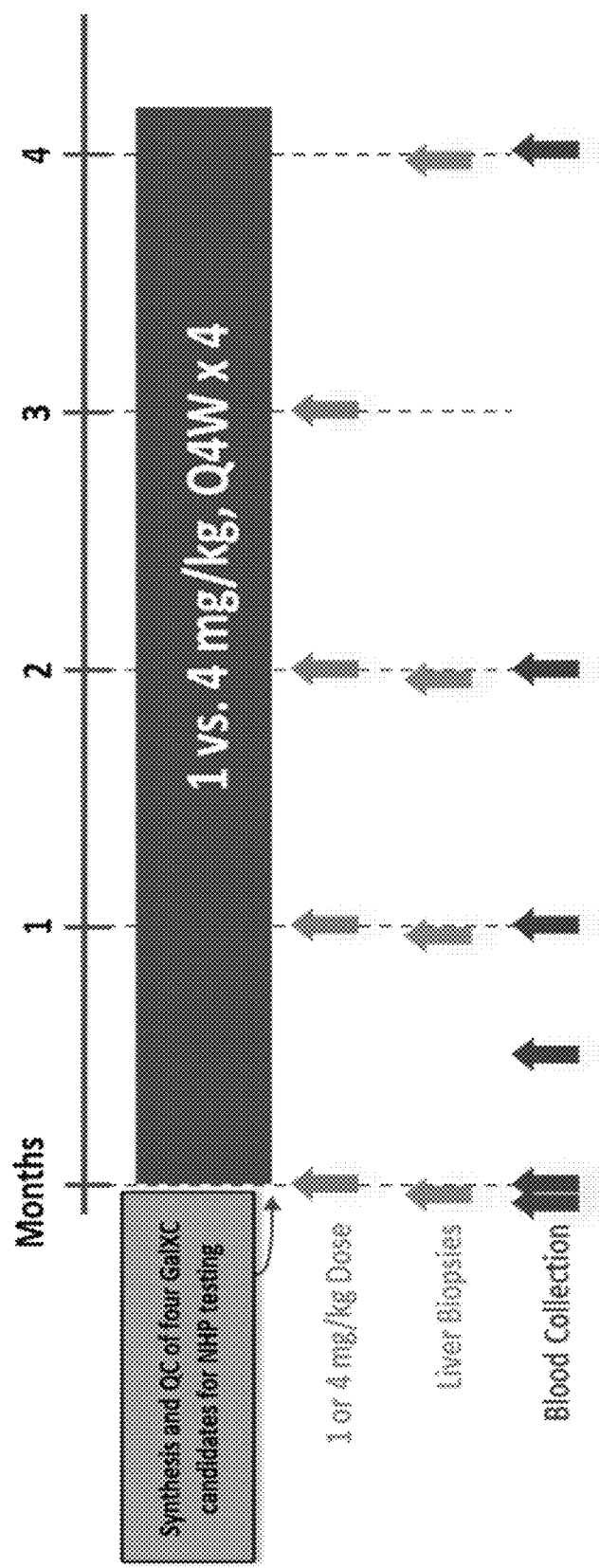
FIG. 11 provides a schematic depicting the dosing and specimen collection schedules for non-human primate (NHP) studies using GalNAc-conjugated MARC1 oligonucleotides.

Example 5 RNAi Oligonucleotide Inhibition of MARC1 Expression and Studies in NHP Effective GalNAc-conjugated MARC1 oligonucleotides identified in the HDI mouse studies were assayed for targeting efficiency in NHP. Specifically, GalNAc-conjugated MARC1 oligonucleotides listed in Table 6 were evaluated in non-naïve cynomolgus monkeys (*Macaca fascicularis*). In this study, the monkeys were grouped so that their mean body weights (about 2.5 kg) were comparable between the control and experimental groups. Each cohort contained all male subjects. The GalNAc-conjugated MARC1 oligonucleotides were administered subcutaneously at a dose of either 1 mg/kg or 4 mg/kg on study days 0, 28, 54, and 86. As depicted in the study scheme in FIG. 11, blood samples were collected two weeks prior to dosing (Day −14), on the dosing date (Day 1) and days 15, 29, 57, and 113 after dosing. Ultrasound-guided core needle liver biopsies were collected on Study Days −13, 27, 55, and 111. At each time point, total RNA derived from the liver biopsy samples was subjected to qRT-PCR analysis to measure MARC1 mRNA in oligonucleotide-treated monkeys relative to those treated amount of MARC1 mRNA in liver samples from oligonucleotide-treated NHPs relative to NHPs treated with PBS (Table 7).

TABLE 6

Single-dose GalNAc-conjugated-MARC1 Oligonucleotides for NHP Study

| Name | Sense strand (SEQ ID NO) | Anti-sense strand (SEQ ID NO) |
|---|---|---|
| MARC1-0736 | 1615 | 1651 |
| MARC1-0965 | 1632 | 1668 |
| MARC1-1983 | 1640 | 1676 |
| MARC1-2016 | 1625 | 1661 |

Table 7 provides the percent (%) of NHP MARC1 mRNA remaining after treatment with GalNAc-conjugated MARC1 oligonucleotides. NHP were treated with four doses of the indicated oligonucleotides at 1 mg/kg or 4 mg/kg according to the dosing scheme shown in FIG. 11. The percent (%) of mRNA remaining in liver was determined in livers collected on the indicated days (0, 28, 56, and 112). No difference was observed in weight among treatment groups.

TABLE 7

MARC1 mRNA in liver samples from oligonucleotide-treated NHPs Percent (%) MARC1 mRNA (normalized to pre-dose & time matched PBS)

| | | Study Day | | | |
|---|---|---|---|---|---|
| | | 0 | 28 | 56 | 112 |
| PBS | Mean | 100 | 100.0 | 100.0 | 100.0 |
| | SEM | 0 | 17.7 | 17.2 | 16.2 |
| 1 mg/kg MARC1-0736 | Mean | 100 | 74.6 | 34.8 | 48.6 |
| | SEM | 0 | 17.0 | 6.4 | 5.9 |
| 4 mg/kg MARC1-0736 | Mean | 100 | 38.1 | 18.3 | 35.3 |
| | SEM | 0 | 6.9 | 6.2 | 8.6 |
| 1 mg/kg MARC1-0965 | Mean | 100 | 80.5 | 32.2 | 41.1 |
| | SEM | 0 | 15.0 | 12.1 | 14.2 |
| 4 mg/kg MARC1-0965 | Mean | 100 | 57.7 | 23.3 | 39.5 |
| | SEM | 0 | 9.4 | 4.6 | 6.7 |
| 1 mg/kg MARC1-1983 | Mean | 100 | 81.0 | 70.6 | 93.6 |
| | SEM | 0 | 12.6 | 11.0 | 8.4 |
| 4 mg/kg MARC1-1983 | Mean | 100 | 49.8 | 34.5 | 68.8 |
| | SEM | 0 | 6.2 | 6.3 | 8.7 |
| 1 mg/kg MARC1-2016 | Mean | 100 | 83.9 | 71.9 | 120.3 |
| | SEM | 0 | 9.4 | 17.4 | 23.5 |
| 4 mg/kg MARC1-2016 | Mean | 100 | 62.0 | 56.1 | 71.1 |
| | SEM | 0 | 14.7 | 15.4 | 16.8 |

Gene expression related to phosphatidylcholine metabolism (DGAT1, DGAT2, MTTP, APOB, CHKA, CHKB, PCYT1A, CEPT1, PEMT, PCYT2, ETNK, FMO3, ACC2, FASN, and FABP) was measured on days 27, 55, and 111 and showed no changes between PBS and GalNAc-conjugated MARC1 oligonucleotide treated NHPs (data not shown). Circulating lipids were measured on days 14, 29, 57, and 113 and there was no difference observed in TG, Cholesterol, LDLc, HDLc, or ApoB100 between PBS and GalNAc-conjugated MARC1 oligonucleotide treated NHPs (data not shown). Similarly, no difference was observed in liver enzymes including alanine aminotransferase (ALT), aspartate transaminase (AST), alkaline phosphatase (ALP), or gamma-glutamyl transferase (GGT) (data not shown).

Taken together, these results show that GalNAc-conjugated MARC1 oligonucleotides designed to target human MARC1 mRNA inhibit MARC1 expression in vivo in the liver (as determined by the reduction in amount of hepatic MARC1 mRNA).

Example 6—Effect of Reducing MARC1 mRNA on Lipid Accumulation In Vitro

The effect on lipid accumulation through the reduction of MARC1 mRNA was assessed in vitro using primary human hepatocytes (PHH).
Briefly, PHH expressing endogenous human MARC1 gene were cultured for 27 days using long-term maintenance media (Xiang et al, Science 364, 399-402, 2019). A total of 7 PHH donors were used across 25 individual experiments.
On day 7 PHH were transfected with 30 nM Dharmacon ON-TARGET plus Human MARC1 siRNA (L-019358-02-0010) or non-targeting siRNA (D-001810-10-20). On day 24 cells were treated with 0 or 800 μM of a BSA conjugated Free Fatty Acids (FFA) mixture comprised of Oleic Acid, Linoleic Acid, Alpha Linoleic Acid and Palmitic Acid. On day 27 cells were harvested for mRNA or fixed with 4% formaldehyde.

Expression levels of MARC1 (TaqMan™ Gene Expression Assays #4331182, Hs00224227_m1) and a housekeeping gene, TBP (Hs00427620_m1), were determined by qRT-PCR. MARC1 siRNA reduced MARC1 mRNA with an average of 18% and 14% MARC1 mRNA remaining after 0 and 800 μM FFA treatment, respectively, compared to non-targeting siRNA (Table 8).

Fixed cells were stained using Nile Red to quantify lipid accumulation (Diaz et al, Micron 39, 819-824, 2008). The Nile Red ratio was calculated as the neutral lipid fluorescence (540-15 nm/600-20 nm) divided by the phospholipid fluorescence (540-15 nm/640-20 nm). To normalize data across experiments non-targeting siRNA values were set to 0% for 0 μM FFA and 100% for 800 μM FFA treatment using the following equation: % of lipid accumulation=((Nile Red Ratio$_x$–Nile Red Ratio$_{non-targeting\ 0\ \mu M\ FFA}$)/(Nile Red Ratio$_{non-targeting\ 800\ \mu M\ FFA}$–Nile Red Ratio$_{non-targeting\ 0\ \mu M\ FFA}$))×100.

In Table 8, lipid accumulation and MARC1 RNA shown % remaining in 7 PHH donors across 25 independent experiments following transfection with MARC1 siRNA and treatment with either 0 or 800 μM FFA. Non-targeting control values at 0 μM were set to 0% and at 800 μM were set to 100%. Two-way ANOVA analysis demonstrated significant Fat and siRNA main effects. **$p<0.01$ compared to non-targeting siRNA within fat treatment by Sidak's multiple comparison test. n/a=unable to obtain values due to unsuccessful isolation of RNA.

MARC1 siRNA significantly ($p<0.01$) reduced lipid accumulation by 27% and 35% at 0 and 800 μM FFA, respectively, compared to non-targeting siRNA (Table 8). It was concluded that the knockdown of MARC1 significantly lowered both basal and FFA-induced lipid accumulation in cultured PHH.

TABLE 8

Effects of MARC1 siRNA on lipid accumulation and mRNA in PHH.

| | | MARC1 | | | |
|---|---|---|---|---|---|
| | | 0 μM FFA | | 800 μM FFA | |
| Donor | Experiment | % lipid Accumulation | % remaining (RNA) | % lipid Accumulation | % remaining (RNA) |
| Donor A | 1 | −19 | 8 | 29 | 4 |
| Donor A | 2 | −3 | 5 | 53 | 5 |
| Donor B | 1 | −21 | n/a | 68 | n/a |
| Donor C | 1 | 19 | 17 | 125 | 17 |
| Donor C | 2 | −140 | 7 | −39 | 6 |
| Donor C | 3 | −65 | 9 | 34 | 8 |
| Donor C | 4 | −125 | 7 | 36 | 4 |
| Donor C | 5 | −53 | 11 | 77 | 9 |
| Donor C | 6 | −24 | 88 | 68 | 17 |
| Donor D | 1 | 2 | 6 | 98 | 5 |
| Donor D | 2 | −16 | 14 | 86 | 14 |
| Donor E | 1 | −13 | 9 | 41 | 10 |
| Donor E | 2 | −17 | 28 | 45 | 4 |
| Donor E | 3 | −72 | 9 | 21 | 8 |
| Donor E | 4 | −26 | 10 | 56 | 8 |
| Donor E | 5 | −3 | 8 | 53 | 10 |
| Donor E | 6 | −36 | 8 | 25 | 7 |
| Donor F | 1 | −2 | 12 | 107 | 13 |
| Donor F | 2 | −81 | 33 | −25 | 31 |
| Donor F | 3 | 10 | 17 | 152 | 15 |
| Donor F | 4 | 4 | 28 | 110 | 29 |
| Donor F | 5 | 1 | 29 | 121 | 55 |

TABLE 8-continued

Effects of MARC1 siRNA on lipid accumulation and mRNA in PHH.

| | | MARC1 | | | |
|---|---|---|---|---|---|
| | | 0 µM FFA | | 800 µM FFA | |
| Donor | Experiment | % lipid Accumulation | % remaining (RNA) | % lipid Accumulation | % remaining (RNA) |
| Donor F | 6 | −2 | 27 | 102 | 25 |
| Donor G | 1 | −11 | 17 | 92 | 16 |
| Donor G | 2 | 11 | 23 | 99 | 17 |
| Average | | −27** | 18 | 65** | 14 |

SEQUENCE LISTING

| Name | Strand | Sequence | SEQ ID NO |
|---|---|---|---|
| MTARC1-231 | 19 mer Sense Strand | GCGCAGCUCUGGAUCUACC | 1 |
| MTARC1-233 | 19 mer Sense Strand | GCAGCUCUGGAUCUACCCU | 2 |
| MTARC1-234 | 19 mer Sense Strand | CAGCUCUGGAUCUACCCUG | 3 |
| MTARC1-235 | 19 mer Sense Strand | AGCUCUGGAUCUACCCUGU | 4 |
| MTARC1-236 | 19 mer Sense Strand | GCUCUGGAUCUACCCUGUG | 5 |
| MTARC1-237 | 19 mer Sense Strand | CUCUGGAUCUACCCUGUGA | 6 |
| MTARC1-238 | 19 mer Sense Strand | UCUGGAUCUACCCUGUGAA | 7 |
| MTARC1-239 | 19 mer Sense Strand | CUGGAUCUACCCUGUGAAA | 8 |
| MTARC1-240 | 19 mer Sense Strand | UGGAUCUACCCUGUGAAAU | 9 |
| MTARC1-241 | 19 mer Sense Strand | GGAUCUACCCUGUGAAAUC | 10 |
| MTARC1-242 | 19 mer Sense Strand | GAUCUACCCUGUGAAAUCC | 11 |
| MTARC1-243 | 19 mer Sense Strand | AUCUACCCUGUGAAAUCCU | 12 |
| MTARC1-244 | 19 mer Sense Strand | UCUACCCUGUGAAAUCCUG | 13 |
| MTARC1-245 | 19 mer Sense Strand | CUACCCUGUGAAAUCCUGC | 14 |
| MTARC1-247 | 19 mer Sense Strand | ACCCUGUGAAAUCCUGCAA | 15 |
| MTARC1-248 | 19 mer Sense Strand | CCCUGUGAAAUCCUGCAAG | 16 |
| MTARC1-249 | 19 mer Sense Strand | CCUGUGAAAUCCUGCAAGG | 17 |
| MTARC1-253 | 19 mer Sense Strand | UGAAAUCCUGCAAGGGGGU | 18 |
| MTARC1-255 | 19 mer Sense Strand | AAAUCCUGCAAGGGGUGC | 19 |
| MTARC1-318 | 19 mer Sense Strand | AACCUGCGGGACAGGUUUU | 20 |
| MTARC1-319 | 19 mer Sense Strand | ACCUGCGGGACAGGUUUUG | 21 |
| MTARC1-320 | 19 mer Sense Strand | CCUGCGGGACAGGUUUUGG | 22 |
| MTARC1-321 | 19 mer Sense Strand | CUGCGGGACAGGUUUUGGC | 23 |
| MTARC1-323 | 19 mer Sense Strand | GCGGGACAGGUUUUGGCUU | 24 |
| MTARC1-324 | 19 mer Sense Strand | CGGGACAGGUUUUGGCUUG | 25 |
| MTARC1-325 | 19 mer Sense Strand | GGGACAGGUUUUGGCUUGU | 26 |
| MTARC1-326 | 19 mer Sense Strand | GGACAGGUUUUGGCUUGUG | 27 |
| MTARC1-327 | 19 mer Sense Strand | GACAGGUUUUGGCUUGUGA | 28 |

SEQUENCE LISTING

| Name | Strand | Sequence | SEQ ID NO |
|---|---|---|---|
| MTARC1-328 | 19 mer Sense Strand | ACAGGUUUUGGCUUGUGAU | 29 |
| MTARC1-329 | 19 mer Sense Strand | CAGGUUUUGGCUUGUGAUC | 30 |
| MTARC1-330 | 19 mer Sense Strand | AGGUUUUGGCUUGUGAUCA | 31 |
| MTARC1-331 | 19 mer Sense Strand | GGUUUUGGCUUGUGAUCAA | 32 |
| MTARC1-332 | 19 mer Sense Strand | GUUUUGGCUUGUGAUCAAC | 33 |
| MTARC1-334 | 19 mer Sense Strand | UUUGGCUUGUGAUCAACCA | 34 |
| MTARC1-335 | 19 mer Sense Strand | UUGGCUUGUGAUCAACCAG | 35 |
| MTARC1-337 | 19 mer Sense Strand | GGCUUGUGAUCAACCAGGA | 36 |
| MTARC1-338 | 19 mer Sense Strand | GCUUGUGAUCAACCAGGAG | 37 |
| MTARC1-339 | 19 mer Sense Strand | CUUGUGAUCAACCAGGAGG | 38 |
| MTARC1-340 | 19 mer Sense Strand | UUGUGAUCAACCAGGAGGG | 39 |
| MTARC1-341 | 19 mer Sense Strand | UGUGAUCAACCAGGAGGGA | 40 |
| MTARC1-342 | 19 mer Sense Strand | GUGAUCAACCAGGAGGGAA | 41 |
| MTARC1-343 | 19 mer Sense Strand | UGAUCAACCAGGAGGGAAA | 42 |
| MTARC1-345 | 19 mer Sense Strand | AUCAACCAGGAGGGAAACA | 43 |
| MTARC1-346 | 19 mer Sense Strand | UCAACCAGGAGGGAAACAU | 44 |
| MTARC1-347 | 19 mer Sense Strand | CAACCAGGAGGGAAACAUG | 45 |
| MTARC1-348 | 19 mer Sense Strand | AACCAGGAGGGAAACAUGG | 46 |
| MTARC1-349 | 19 mer Sense Strand | ACCAGGAGGGAAACAUGGU | 47 |
| MTARC1-350 | 19 mer Sense Strand | CCAGGAGGGAAACAUGGUU | 48 |
| MTARC1-351 | 19 mer Sense Strand | CAGGAGGGAAACAUGGUUA | 49 |
| MTARC1-352 | 19 mer Sense Strand | AGGAGGGAAACAUGGUUAC | 50 |
| MTARC1-353 | 19 mer Sense Strand | GGAGGGAAACAUGGUUACU | 51 |
| MTARC1-354 | 19 mer Sense Strand | GAGGGAAACAUGGUUACUG | 52 |
| MTARC1-356 | 19 mer Sense Strand | GGGAAACAUGGUUACUGCU | 53 |
| MTARC1-357 | 19 mer Sense Strand | GGAAACAUGGUUACUGCUC | 54 |
| MTARC1-358 | 19 mer Sense Strand | GAAACAUGGUUACUGCUCG | 55 |
| MTARC1-359 | 19 mer Sense Strand | AAACAUGGUUACUGCUCGC | 56 |
| MTARC1-360 | 19 mer Sense Strand | AACAUGGUUACUGCUCGCC | 57 |
| MTARC1-361 | 19 mer Sense Strand | ACAUGGUUACUGCUCGCCA | 58 |
| MTARC1-362 | 19 mer Sense Strand | CAUGGUUACUGCUCGCCAG | 59 |
| MTARC1-365 | 19 mer Sense Strand | GGUUACUGCUCGCCAGGAA | 60 |
| MTARC1-376 | 19 mer Sense Strand | GCCAGGAACCUCGCCUGGU | 61 |
| MTARC1-379 | 19 mer Sense Strand | AGGAACCUCGCCUGGUCCU | 62 |
| MTARC1-384 | 19 mer Sense Strand | CCUCGCCUGGUCCUGAUUU | 63 |
| MTARC1-385 | 19 mer Sense Strand | CUCGCCUGGUCCUGAUUUC | 64 |
| MTARC1-388 | 19 mer Sense Strand | GCCUGGUCCUGAUUUCCCU | 65 |

-continued

SEQUENCE LISTING

| Name | Strand | Sequence | SEQ ID NO |
|---|---|---|---|
| MTARC1-390 | 19 mer Sense Strand | CUGGUCCUGAUUUCCCUGA | 66 |
| MTARC1-391 | 19 mer Sense Strand | UGGUCCUGAUUUCCCUGAC | 67 |
| MTARC1-393 | 19 mer Sense Strand | GUCCUGAUUUCCCUGACCU | 68 |
| MTARC1-395 | 19 mer Sense Strand | CCUGAUUUCCCUGACCUGC | 69 |
| MTARC1-405 | 19 mer Sense Strand | CUGACCUGCGAUGGUGACA | 70 |
| MTARC1-409 | 19 mer Sense Strand | CCUGCGAUGGUGACACCCU | 71 |
| MTARC1-411 | 19 mer Sense Strand | UGCGAUGGUGACACCCUGA | 72 |
| MTARC1-412 | 19 mer Sense Strand | GCGAUGGUGACACCCUGAC | 73 |
| MTARC1-413 | 19 mer Sense Strand | CGAUGGUGACACCCUGACU | 74 |
| MTARC1-414 | 19 mer Sense Strand | GAUGGUGACACCCUGACUC | 75 |
| MTARC1-415 | 19 mer Sense Strand | AUGGUGACACCCUGACUCU | 76 |
| MTARC1-416 | 19 mer Sense Strand | UGGUGACACCCUGACUCUC | 77 |
| MTARC1-417 | 19 mer Sense Strand | GGUGACACCCUGACUCUCA | 78 |
| MTARC1-418 | 19 mer Sense Strand | GUGACACCCUGACUCUCAG | 79 |
| MTARC1-419 | 19 mer Sense Strand | UGACACCCUGACUCUCAGU | 80 |
| MTARC1-420 | 19 mer Sense Strand | GACACCCUGACUCUCAGUG | 81 |
| MTARC1-421 | 19 mer Sense Strand | ACACCCUGACUCUCAGUGC | 82 |
| MTARC1-422 | 19 mer Sense Strand | CACCCUGACUCUCAGUGCA | 83 |
| MTARC1-423 | 19 mer Sense Strand | ACCCUGACUCUCAGUGCAG | 84 |
| MTARC1-424 | 19 mer Sense Strand | CCCUGACUCUCAGUGCAGC | 85 |
| MTARC1-425 | 19 mer Sense Strand | CCUGACUCUCAGUGCAGCC | 86 |
| MTARC1-426 | 19 mer Sense Strand | CUGACUCUCAGUGCAGCCU | 87 |
| MTARC1-427 | 19 mer Sense Strand | UGACUCUCAGUGCAGCCUA | 88 |
| MTARC1-428 | 19 mer Sense Strand | GACUCUCAGUGCAGCCUAC | 89 |
| MTARC1-429 | 19 mer Sense Strand | ACUCUCAGUGCAGCCUACA | 90 |
| MTARC1-430 | 19 mer Sense Strand | CUCUCAGUGCAGCCUACAC | 91 |
| MTARC1-431 | 19 mer Sense Strand | UCUCAGUGCAGCCUACACA | 92 |
| MTARC1-433 | 19 mer Sense Strand | UCAGUGCAGCCUACACAAA | 93 |
| MTARC1-434 | 19 mer Sense Strand | CAGUGCAGCCUACACAAAG | 94 |
| MTARC1-435 | 19 mer Sense Strand | AGUGCAGCCUACACAAAGG | 95 |
| MTARC1-436 | 19 mer Sense Strand | GUGCAGCCUACACAAAGGA | 96 |
| MTARC1-437 | 19 mer Sense Strand | UGCAGCCUACACAAAGGAC | 97 |
| MTARC1-438 | 19 mer Sense Strand | GCAGCCUACACAAAGGACC | 98 |
| MTARC1-439 | 19 mer Sense Strand | CAGCCUACACAAAGGACCU | 99 |
| MTARC1-440 | 19 mer Sense Strand | AGCCUACACAAAGGACCUA | 100 |
| MTARC1-441 | 19 mer Sense Strand | GCCUACACAAAGGACCUAC | 101 |

-continued

SEQUENCE LISTING

| Name | Strand | Sequence | SEQ ID NO |
|---|---|---|---|
| MTARC1-445 | 19 mer Sense Strand | ACACAAAGGACCUACUACU | 102 |
| MTARC1-446 | 19 mer Sense Strand | CACAAAGGACCUACUACUG | 103 |
| MTARC1-447 | 19 mer Sense Strand | ACAAAGGACCUACUACUGC | 104 |
| MTARC1-448 | 19 mer Sense Strand | CAAAGGACCUACUACUGCC | 105 |
| MTARC1-449 | 19 mer Sense Strand | AAAGGACCUACUACUGCCU | 106 |
| MTARC1-450 | 19 mer Sense Strand | AAGGACCUACUACUGCCUA | 107 |
| MTARC1-451 | 19 mer Sense Strand | AGGACCUACUACUGCCUAU | 108 |
| MTARC1-452 | 19 mer Sense Strand | GGACCUACUACUGCCUAUC | 109 |
| MTARC1-453 | 19 mer Sense Strand | GACCUACUACUGCCUAUCA | 110 |
| MTARC1-454 | 19 mer Sense Strand | ACCUACUACUGCCUAUCAA | 111 |
| MTARC1-456 | 19 mer Sense Strand | CUACUACUGCCUAUCAAAA | 112 |
| MTARC1-457 | 19 mer Sense Strand | UACUACUGCCUAUCAAAAC | 113 |
| MTARC1-458 | 19 mer Sense Strand | ACUACUGCCUAUCAAAACG | 114 |
| MTARC1-459 | 19 mer Sense Strand | CUACUGCCUAUCAAAACGC | 115 |
| MTARC1-460 | 19 mer Sense Strand | UACUGCCUAUCAAAACGCC | 116 |
| MTARC1-462 | 19 mer Sense Strand | CUGCCUAUCAAAACGCCCA | 117 |
| MTARC1-468 | 19 mer Sense Strand | AUCAAAACGCCCACCACAA | 118 |
| MTARC1-469 | 19 mer Sense Strand | UCAAAACGCCCACCACAAA | 119 |
| MTARC1-470 | 19 mer Sense Strand | CAAAACGCCCACCACAAAU | 120 |
| MTARC1-471 | 19 mer Sense Strand | AAAACGCCCACCACAAAUG | 121 |
| MTARC1-473 | 19 mer Sense Strand | AACGCCCACCACAAAUGCA | 122 |
| MTARC1-475 | 19 mer Sense Strand | CGCCCACCACAAAUGCAGU | 123 |
| MTARC1-476 | 19 mer Sense Strand | GCCCACCACAAAUGCAGUG | 124 |
| MTARC1-482 | 19 mer Sense Strand | CACAAAUGCAGUGCACAAG | 125 |
| MTARC1-483 | 19 mer Sense Strand | ACAAAUGCAGUGCACAAGU | 126 |
| MTARC1-484 | 19 mer Sense Strand | CAAAUGCAGUGCACAAGUG | 127 |
| MTARC1-552 | 19 mer Sense Strand | GCCCAGUGGAUAACCAGCU | 128 |
| MTARC1-553 | 19 mer Sense Strand | CCCAGUGGAUAACCAGCUU | 129 |
| MTARC1-554 | 19 mer Sense Strand | CCAGUGGAUAACCAGCUUC | 130 |
| MTARC1-555 | 19 mer Sense Strand | CAGUGGAUAACCAGCUUCC | 131 |
| MTARC1-556 | 19 mer Sense Strand | AGUGGAUAACCAGCUUCCU | 132 |
| MTARC1-557 | 19 mer Sense Strand | GUGGAUAACCAGCUUCCUG | 133 |
| MTARC1-558 | 19 mer Sense Strand | UGGAUAACCAGCUUCCUGA | 134 |
| MTARC1-559 | 19 mer Sense Strand | GGAUAACCAGCUUCCUGAA | 135 |
| MTARC1-560 | 19 mer Sense Strand | GAUAACCAGCUUCCUGAAG | 136 |
| MTARC1-561 | 19 mer Sense Strand | AUAACCAGCUUCCUGAAGU | 137 |
| MTARC1-562 | 19 mer Sense Strand | UAACCAGCUUCCUGAAGUC | 138 |

-continued

SEQUENCE LISTING

| Name | Strand | Sequence | SEQ ID NO |
|---|---|---|---|
| MTARC1-563 | 19 mer Sense Strand | AACCAGCUUCCUGAAGUCA | 139 |
| MTARC1-564 | 19 mer Sense Strand | ACCAGCUUCCUGAAGUCAC | 140 |
| MTARC1-565 | 19 mer Sense Strand | CCAGCUUCCUGAAGUCACA | 141 |
| MTARC1-566 | 19 mer Sense Strand | CAGCUUCCUGAAGUCACAG | 142 |
| MTARC1-567 | 19 mer Sense Strand | AGCUUCCUGAAGUCACAGC | 143 |
| MTARC1-568 | 19 mer Sense Strand | GCUUCCUGAAGUCACAGCC | 144 |
| MTARC1-589 | 19 mer Sense Strand | ACCGCCUGGUGCACUUCGA | 145 |
| MTARC1-591 | 19 mer Sense Strand | CGCCUGGUGCACUUCGAGC | 146 |
| MTARC1-592 | 19 mer Sense Strand | GCCUGGUGCACUUCGAGCC | 147 |
| MTARC1-593 | 19 mer Sense Strand | CCUGGUGCACUUCGAGCCU | 148 |
| MTARC1-597 | 19 mer Sense Strand | GUGCACUUCGAGCCUCACA | 149 |
| MTARC1-600 | 19 mer Sense Strand | CACUUCGAGCCUCACAUGC | 150 |
| MTARC1-612 | 19 mer Sense Strand | CACAUGCGACCGAGACGUC | 151 |
| MTARC1-614 | 19 mer Sense Strand | CAUGCGACCGAGACGUCCU | 152 |
| MTARC1-617 | 19 mer Sense Strand | GCGACCGAGACGUCCUCAU | 153 |
| MTARC1-618 | 19 mer Sense Strand | CGACCGAGACGUCCUCAUC | 154 |
| MTARC1-620 | 19 mer Sense Strand | ACCGAGACGUCCUCAUCAA | 155 |
| MTARC1-621 | 19 mer Sense Strand | CCGAGACGUCCUCAUCAAA | 156 |
| MTARC1-622 | 19 mer Sense Strand | CGAGACGUCCUCAUCAAAU | 157 |
| MTARC1-623 | 19 mer Sense Strand | GAGACGUCCUCAUCAAAUA | 158 |
| MTARC1-624 | 19 mer Sense Strand | AGACGUCCUCAUCAAAUAG | 159 |
| MTARC1-625 | 19 mer Sense Strand | GACGUCCUCAUCAAAUAGC | 160 |
| MTARC1-626 | 19 mer Sense Strand | ACGUCCUCAUCAAAUAGCA | 161 |
| MTARC1-627 | 19 mer Sense Strand | CGUCCUCAUCAAAUAGCAG | 162 |
| MTARC1-628 | 19 mer Sense Strand | GUCCUCAUCAAAUAGCAGA | 163 |
| MTARC1-629 | 19 mer Sense Strand | UCCUCAUCAAAUAGCAGAC | 164 |
| MTARC1-630 | 19 mer Sense Strand | CCUCAUCAAAUAGCAGACU | 165 |
| MTARC1-631 | 19 mer Sense Strand | CUCAUCAAAUAGCAGACUU | 166 |
| MTARC1-632 | 19 mer Sense Strand | UCAUCAAAUAGCAGACUUG | 167 |
| MTARC1-633 | 19 mer Sense Strand | CAUCAAAUAGCAGACUUGU | 168 |
| MTARC1-634 | 19 mer Sense Strand | AUCAAAUAGCAGACUUGUU | 169 |
| MTARC1-635 | 19 mer Sense Strand | UCAAAUAGCAGACUUGUUC | 170 |
| MTARC1-636 | 19 mer Sense Strand | CAAAUAGCAGACUUGUUCC | 171 |
| MTARC1-637 | 19 mer Sense Strand | AAAUAGCAGACUUGUUCCG | 172 |
| MTARC1-638 | 19 mer Sense Strand | AAUAGCAGACUUGUUCCGA | 173 |
| MTARC1-639 | 19 mer Sense Strand | AUAGCAGACUUGUUCCGAC | 174 |

SEQUENCE LISTING

| Name | Strand | Sequence | SEQ ID NO |
|---|---|---|---|
| MTARC1-640 | 19 mer Sense Strand | UAGCAGACUUGUUCCGACC | 175 |
| MTARC1-641 | 19 mer Sense Strand | AGCAGACUUGUUCCGACCC | 176 |
| MTARC1-642 | 19 mer Sense Strand | GCAGACUUGUUCCGACCCA | 177 |
| MTARC1-643 | 19 mer Sense Strand | CAGACUUGUUCCGACCCAA | 178 |
| MTARC1-644 | 19 mer Sense Strand | AGACUUGUUCCGACCCAAG | 179 |
| MTARC1-645 | 19 mer Sense Strand | GACUUGUUCCGACCCAAGG | 180 |
| MTARC1-646 | 19 mer Sense Strand | ACUUGUUCCGACCCAAGGA | 181 |
| MTARC1-647 | 19 mer Sense Strand | CUUGUUCCGACCCAAGGAC | 182 |
| MTARC1-648 | 19 mer Sense Strand | UUGUUCCGACCCAAGGACC | 183 |
| MTARC1-649 | 19 mer Sense Strand | UGUUCCGACCCAAGGACCA | 184 |
| MTARC1-650 | 19 mer Sense Strand | GUUCCGACCCAAGGACCAG | 185 |
| MTARC1-651 | 19 mer Sense Strand | UUCCGACCCAAGGACCAGA | 186 |
| MTARC1-652 | 19 mer Sense Strand | UCCGACCCAAGGACCAGAU | 187 |
| MTARC1-653 | 19 mer Sense Strand | CCGACCCAAGGACCAGAUU | 188 |
| MTARC1-654 | 19 mer Sense Strand | CGACCCAAGGACCAGAUUG | 189 |
| MTARC1-655 | 19 mer Sense Strand | GACCCAAGGACCAGAUUGC | 190 |
| MTARC1-656 | 19 mer Sense Strand | ACCCAAGGACCAGAUUGCU | 191 |
| MTARC1-657 | 19 mer Sense Strand | CCCAAGGACCAGAUUGCUU | 192 |
| MTARC1-658 | 19 mer Sense Strand | CCAAGGACCAGAUUGCUUA | 193 |
| MTARC1-659 | 19 mer Sense Strand | CAAGGACCAGAUUGCUUAC | 194 |
| MTARC1-660 | 19 mer Sense Strand | AAGGACCAGAUUGCUUACU | 195 |
| MTARC1-661 | 19 mer Sense Strand | AGGACCAGAUUGCUUACUC | 196 |
| MTARC1-662 | 19 mer Sense Strand | GGACCAGAUUGCUUACUCA | 197 |
| MTARC1-663 | 19 mer Sense Strand | GACCAGAUUGCUUACUCAG | 198 |
| MTARC1-664 | 19 mer Sense Strand | ACCAGAUUGCUUACUCAGA | 199 |
| MTARC1-665 | 19 mer Sense Strand | CCAGAUUGCUUACUCAGAC | 200 |
| MTARC1-666 | 19 mer Sense Strand | CAGAUUGCUUACUCAGACA | 201 |
| MTARC1-667 | 19 mer Sense Strand | AGAUUGCUUACUCAGACAC | 202 |
| MTARC1-668 | 19 mer Sense Strand | GAUUGCUUACUCAGACACC | 203 |
| MTARC1-669 | 19 mer Sense Strand | AUUGCUUACUCAGACACCA | 204 |
| MTARC1-670 | 19 mer Sense Strand | UUGCUUACUCAGACACCAG | 205 |
| MTARC1-671 | 19 mer Sense Strand | UGCUUACUCAGACACCAGC | 206 |
| MTARC1-672 | 19 mer Sense Strand | GCUUACUCAGACACCAGCC | 207 |
| MTARC1-673 | 19 mer Sense Strand | CUUACUCAGACACCAGCCC | 208 |
| MTARC1-674 | 19 mer Sense Strand | UUACUCAGACACCAGCCCA | 209 |
| MTARC1-675 | 19 mer Sense Strand | UACUCAGACACCAGCCCAU | 210 |
| MTARC1-676 | 19 mer Sense Strand | ACUCAGACACCAGCCCAUU | 211 |

SEQUENCE LISTING

| Name | Strand | Sequence | SEQ ID NO |
|---|---|---|---|
| MTARC1-677 | 19 mer Sense Strand | CUCAGACACCAGCCCAUUC | 212 |
| MTARC1-678 | 19 mer Sense Strand | UCAGACACCAGCCCAUUCU | 213 |
| MTARC1-679 | 19 mer Sense Strand | CAGACACCAGCCCAUUCUU | 214 |
| MTARC1-680 | 19 mer Sense Strand | AGACACCAGCCCAUUCUUG | 215 |
| MTARC1-681 | 19 mer Sense Strand | GACACCAGCCCAUUCUUGA | 216 |
| MTARC1-682 | 19 mer Sense Strand | ACACCAGCCCAUUCUUGAU | 217 |
| MTARC1-683 | 19 mer Sense Strand | CACCAGCCCAUUCUUGAUC | 218 |
| MTARC1-684 | 19 mer Sense Strand | ACCAGCCCAUUCUUGAUCC | 219 |
| MTARC1-685 | 19 mer Sense Strand | CCAGCCCAUUCUUGAUCCU | 220 |
| MTARC1-686 | 19 mer Sense Strand | CAGCCCAUUCUUGAUCCUU | 221 |
| MTARC1-687 | 19 mer Sense Strand | AGCCCAUUCUUGAUCCUUU | 222 |
| MTARC1-691 | 19 mer Sense Strand | CAUUCUUGAUCCUUUCUGA | 223 |
| MTARC1-692 | 19 mer Sense Strand | AUUCUUGAUCCUUUCUGAG | 224 |
| MTARC1-724 | 19 mer Sense Strand | AUCUCAACUCCAGGCUAGA | 225 |
| MTARC1-726 | 19 mer Sense Strand | CUCAACUCCAGGCUAGAGA | 226 |
| MTARC1-728 | 19 mer Sense Strand | CAACUCCAGGCUAGAGAAG | 227 |
| MTARC1-729 | 19 mer Sense Strand | AACUCCAGGCUAGAGAAGA | 228 |
| MTARC1-730 | 19 mer Sense Strand | ACUCCAGGCUAGAGAAGAA | 229 |
| MTARC1-731 | 19 mer Sense Strand | CUCCAGGCUAGAGAAGAAA | 230 |
| MTARC1-733 | 19 mer Sense Strand | CCAGGCUAGAGAAGAAAGU | 231 |
| MTARC1-734 | 19 mer Sense Strand | CAGGCUAGAGAAGAAAGUU | 232 |
| MTARC1-735 | 19 mer Sense Strand | AGGCUAGAGAAGAAAGUUA | 233 |
| MTARC1-736 | 19 mer Sense Strand | GGCUAGAGAAGAAAGUUAA | 234 |
| MTARC1-737 | 19 mer Sense Strand | GCUAGAGAAGAAAGUUAAA | 235 |
| MTARC1-738 | 19 mer Sense Strand | CUAGAGAAGAAAGUUAAAG | 236 |
| MTARC1-739 | 19 mer Sense Strand | UAGAGAAGAAAGUUAAAGC | 237 |
| MTARC1-740 | 19 mer Sense Strand | AGAGAAGAAAGUUAAAGCA | 238 |
| MTARC1-741 | 19 mer Sense Strand | GAGAAGAAAGUUAAAGCAA | 239 |
| MTARC1-742 | 19 mer Sense Strand | AGAAGAAAGUUAAAGCAAC | 240 |
| MTARC1-743 | 19 mer Sense Strand | GAAGAAAGUUAAAGCAACC | 241 |
| MTARC1-744 | 19 mer Sense Strand | AAGAAAGUUAAAGCAACCA | 242 |
| MTARC1-745 | 19 mer Sense Strand | AGAAAGUUAAAGCAACCAA | 243 |
| MTARC1-746 | 19 mer Sense Strand | GAAAGUUAAAGCAACCAAC | 244 |
| MTARC1-747 | 19 mer Sense Strand | AAAGUUAAAGCAACCAACU | 245 |
| MTARC1-748 | 19 mer Sense Strand | AAGUUAAAGCAACCAACUU | 246 |
| MTARC1-750 | 19 mer Sense Strand | GUUAAAGCAACCAACUUCA | 247 |

-continued

SEQUENCE LISTING

| Name | Strand | Sequence | SEQ ID NO |
|---|---|---|---|
| MTARC1-751 | 19 mer Sense Strand | UUAAAGCAACCAACUUCAG | 248 |
| MTARC1-752 | 19 mer Sense Strand | UAAAGCAACCAACUUCAGG | 249 |
| MTARC1-753 | 19 mer Sense Strand | AAAGCAACCAACUUCAGGC | 250 |
| MTARC1-754 | 19 mer Sense Strand | AAGCAACCAACUUCAGGCC | 251 |
| MTARC1-755 | 19 mer Sense Strand | AGCAACCAACUUCAGGCCC | 252 |
| MTARC1-756 | 19 mer Sense Strand | GCAACCAACUUCAGGCCCA | 253 |
| MTARC1-758 | 19 mer Sense Strand | AACCAACUUCAGGCCCAAU | 254 |
| MTARC1-759 | 19 mer Sense Strand | ACCAACUUCAGGCCCAAUA | 255 |
| MTARC1-760 | 19 mer Sense Strand | CCAACUUCAGGCCCAAUAU | 256 |
| MTARC1-761 | 19 mer Sense Strand | CAACUUCAGGCCCAAUAUU | 257 |
| MTARC1-762 | 19 mer Sense Strand | AACUUCAGGCCCAAUAUUG | 258 |
| MTARC1-763 | 19 mer Sense Strand | ACUUCAGGCCCAAUAUUGU | 259 |
| MTARC1-764 | 19 mer Sense Strand | CUUCAGGCCCAAUAUUGUA | 260 |
| MTARC1-765 | 19 mer Sense Strand | UUCAGGCCCAAUAUUGUAA | 261 |
| MTARC1-766 | 19 mer Sense Strand | UCAGGCCCAAUAUUGUAAU | 262 |
| MTARC1-767 | 19 mer Sense Strand | CAGGCCCAAUAUUGUAAUU | 263 |
| MTARC1-768 | 19 mer Sense Strand | AGGCCCAAUAUUGUAAUUU | 264 |
| MTARC1-769 | 19 mer Sense Strand | GGCCCAAUAUUGUAAUUUC | 265 |
| MTARC1-770 | 19 mer Sense Strand | GCCCAAUAUUGUAAUUUCA | 266 |
| MTARC1-771 | 19 mer Sense Strand | CCCAAUAUUGUAAUUUCAG | 267 |
| MTARC1-772 | 19 mer Sense Strand | CCAAUAUUGUAAUUUCAGG | 268 |
| MTARC1-773 | 19 mer Sense Strand | CAAUAUUGUAAUUUCAGGA | 269 |
| MTARC1-774 | 19 mer Sense Strand | AAUAUUGUAAUUUCAGGAU | 270 |
| MTARC1-775 | 19 mer Sense Strand | AUAUUGUAAUUUCAGGAUG | 271 |
| MTARC1-776 | 19 mer Sense Strand | UAUUGUAAUUUCAGGAUGC | 272 |
| MTARC1-777 | 19 mer Sense Strand | AUUGUAAUUUCAGGAUGCG | 273 |
| MTARC1-778 | 19 mer Sense Strand | UUGUAAUUUCAGGAUGCGA | 274 |
| MTARC1-779 | 19 mer Sense Strand | UGUAAUUUCAGGAUGCGAU | 275 |
| MTARC1-780 | 19 mer Sense Strand | GUAAUUUCAGGAUGCGAUG | 276 |
| MTARC1-781 | 19 mer Sense Strand | UAAUUUCAGGAUGCGAUGU | 277 |
| MTARC1-782 | 19 mer Sense Strand | AAUUUCAGGAUGCGAUGUC | 278 |
| MTARC1-783 | 19 mer Sense Strand | AUUUCAGGAUGCGAUGUCU | 279 |
| MTARC1-784 | 19 mer Sense Strand | UUUCAGGAUGCGAUGUCUA | 280 |
| MTARC1-785 | 19 mer Sense Strand | UUCAGGAUGCGAUGUCUAU | 281 |
| MTARC1-786 | 19 mer Sense Strand | UCAGGAUGCGAUGUCUAUG | 282 |
| MTARC1-787 | 19 mer Sense Strand | CAGGAUGCGAUGUCUAUGC | 283 |
| MTARC1-788 | 19 mer Sense Strand | AGGAUGCGAUGUCUAUGCA | 284 |

-continued

SEQUENCE LISTING

| Name | Strand | Sequence | SEQ ID NO |
|---|---|---|---|
| MTARC1-789 | 19 mer Sense Strand | GGAUGCGAUGUCUAUGCAG | 285 |
| MTARC1-790 | 19 mer Sense Strand | GAUGCGAUGUCUAUGCAGA | 286 |
| MTARC1-791 | 19 mer Sense Strand | AUGCGAUGUCUAUGCAGAG | 287 |
| MTARC1-792 | 19 mer Sense Strand | UGCGAUGUCUAUGCAGAGG | 288 |
| MTARC1-863 | 19 mer Sense Strand | UUGUUCCAGAUGCAUUUUA | 289 |
| MTARC1-929 | 19 mer Sense Strand | GGAAACACUGAAGAGUUAU | 290 |
| MTARC1-930 | 19 mer Sense Strand | GAAACACUGAAGAGUUAUC | 291 |
| MTARC1-934 | 19 mer Sense Strand | CACUGAAGAGUUAUCGCCA | 292 |
| MTARC1-955 | 19 mer Sense Strand | GUGACCCUUCAGAACGAAA | 293 |
| MTARC1-959 | 19 mer Sense Strand | CCCUUCAGAACGAAAGUUA | 294 |
| MTARC1-960 | 19 mer Sense Strand | CCUUCAGAACGAAAGUUAU | 295 |
| MTARC1-963 | 19 mer Sense Strand | UCAGAACGAAAGUUAUAUG | 296 |
| MTARC1-964 | 19 mer Sense Strand | CAGAACGAAAGUUAUAUGG | 297 |
| MTARC1-965 | 19 mer Sense Strand | AGAACGAAAGUUAUAUGGA | 298 |
| MTARC1-966 | 19 mer Sense Strand | GAACGAAAGUUAUAUGGAA | 299 |
| MTARC1-967 | 19 mer Sense Strand | AACGAAAGUUAUAUGGAAA | 300 |
| MTARC1-969 | 19 mer Sense Strand | CGAAAGUUAUAUGGAAAAU | 301 |
| MTARC1-970 | 19 mer Sense Strand | GAAAGUUAUAUGGAAAAUC | 302 |
| MTARC1-971 | 19 mer Sense Strand | AAAGUUAUAUGGAAAAUCA | 303 |
| MTARC1-1107 | 19 mer Sense Strand | AAAAAUGUUCUCAAAAAUG | 304 |
| MTARC1-1113 | 19 mer Sense Strand | GUUCUCAAAAAUGACAACA | 305 |
| MTARC1-1118 | 19 mer Sense Strand | CAAAAAUGACAACACUUGA | 306 |
| MTARC1-1123 | 19 mer Sense Strand | AUGACAACACUUGAAGCAU | 307 |
| MTARC1-1126 | 19 mer Sense Strand | ACAACACUUGAAGCAUGGU | 308 |
| MTARC1-1127 | 19 mer Sense Strand | CAACACUUGAAGCAUGGUG | 309 |
| MTARC1-1128 | 19 mer Sense Strand | AACACUUGAAGCAUGGUGU | 310 |
| MTARC1-1129 | 19 mer Sense Strand | ACACUUGAAGCAUGGUGUU | 311 |
| MTARC1-1130 | 19 mer Sense Strand | CACUUGAAGCAUGGUGUUU | 312 |
| MTARC1-1132 | 19 mer Sense Strand | CUUGAAGCAUGGUGUUUCA | 313 |
| MTARC1-1133 | 19 mer Sense Strand | UUGAAGCAUGGUGUUUCAG | 314 |
| MTARC1-1134 | 19 mer Sense Strand | UGAAGCAUGGUGUUUCAGA | 315 |
| MTARC1-1135 | 19 mer Sense Strand | GAAGCAUGGUGUUUCAGAA | 316 |
| MTARC1-1139 | 19 mer Sense Strand | CAUGGUGUUUCAGAACUGA | 317 |
| MTARC1-1144 | 19 mer Sense Strand | UGUUUCAGAACUGAGACCU | 318 |
| MTARC1-1165 | 19 mer Sense Strand | ACAUUUCUUUAAAUUUGU | 319 |
| MTARC1-1167 | 19 mer Sense Strand | AUUUCUUUAAAUUUGUGA | 320 |

-continued

SEQUENCE LISTING

| Name | Strand | Sequence | SEQ ID NO |
|---|---|---|---|
| MTARC1-1173 | 19 mer Sense Strand | UUUAAAUUUGUGAUUUUCA | 321 |
| MTARC1-1177 | 19 mer Sense Strand | AAUUUGUGAUUUUCACAUU | 322 |
| MTARC1-1179 | 19 mer Sense Strand | UUUGUGAUUUUCACAUUUU | 323 |
| MTARC1-1329 | 19 mer Sense Strand | GUUUAACUGAUUAUGGAAU | 324 |
| MTARC1-1330 | 19 mer Sense Strand | UUUAACUGAUUAUGGAAUA | 325 |
| MTARC1-1332 | 19 mer Sense Strand | UAACUGAUUAUGGAAUAGU | 326 |
| MTARC1-1333 | 19 mer Sense Strand | AACUGAUUAUGGAAUAGUU | 327 |
| MTARC1-1334 | 19 mer Sense Strand | ACUGAUUAUGGAAUAGUUC | 328 |
| MTARC1-1335 | 19 mer Sense Strand | CUGAUUAUGGAAUAGUUCU | 329 |
| MTARC1-1620 | 19 mer Sense Strand | CAGAUAUUAAUUUUCCAUA | 330 |
| MTARC1-1622 | 19 mer Sense Strand | GAUAUUAAUUUUCCAUAGA | 331 |
| MTARC1-1660 | 19 mer Sense Strand | CUUCUCAGACAGCAUUGGA | 332 |
| MTARC1-1663 | 19 mer Sense Strand | CUCAGACAGCAUUGGAUUU | 333 |
| MTARC1-1664 | 19 mer Sense Strand | UCAGACAGCAUUGGAUUUC | 334 |
| MTARC1-1812 | 19 mer Sense Strand | AGAAAGUGAUUCAGUGAU | 335 |
| MTARC1-1816 | 19 mer Sense Strand | AAGUGAUUCAGUGAUUUCA | 336 |
| MTARC1-1868 | 19 mer Sense Strand | GGAAAGCAUAUGUCAGUUG | 337 |
| MTARC1-1869 | 19 mer Sense Strand | GAAAGCAUAUGUCAGUUGU | 338 |
| MTARC1-1876 | 19 mer Sense Strand | UAUGUCAGUUGUUUAAAAC | 339 |
| MTARC1-1877 | 19 mer Sense Strand | AUGUCAGUUGUUUAAAACC | 340 |
| MTARC1-1878 | 19 mer Sense Strand | UGUCAGUUGUUUAAAACCC | 341 |
| MTARC1-1879 | 19 mer Sense Strand | GUCAGUUGUUUAAAACCCA | 342 |
| MTARC1-1882 | 19 mer Sense Strand | AGUUGUUUAAAACCCAAUA | 343 |
| MTARC1-1883 | 19 mer Sense Strand | GUUGUUUAAAACCCAAUAU | 344 |
| MTARC1-1884 | 19 mer Sense Strand | UUGUUUAAAACCCAAUAUC | 345 |
| MTARC1-1885 | 19 mer Sense Strand | UGUUUAAAACCCAAUAUCU | 346 |
| MTARC1-1886 | 19 mer Sense Strand | GUUUAAAACCCAAUAUCUA | 347 |
| MTARC1-1935 | 19 mer Sense Strand | UGAUGAAGUAUAUUUUUUA | 348 |
| MTARC1-1936 | 19 mer Sense Strand | GAUGAAGUAUAUUUUUUAU | 349 |
| MTARC1-1937 | 19 mer Sense Strand | AUGAAGUAUAUUUUUUAUU | 350 |
| MTARC1-1939 | 19 mer Sense Strand | GAAGUAUAUUUUUUAUUGC | 351 |
| MTARC1-1941 | 19 mer Sense Strand | AGUAUAUUUUUUAUUGCCA | 352 |
| MTARC1-1953 | 19 mer Sense Strand | AUUGCCAUUUUGUCCUUUG | 353 |
| MTARC1-1955 | 19 mer Sense Strand | UGCCAUUUUGUCCUUUGAU | 354 |
| MTARC1-1981 | 19 mer Sense Strand | GGAAGUUGACUAAACUUGA | 355 |
| MTARC1-1983 | 19 mer Sense Strand | AAGUUGACUAAACUUGAAA | 356 |
| MTARC1-1985 | 19 mer Sense Strand | GUUGACUAAACUUGAAAAA | 357 |

-continued

SEQUENCE LISTING

| Name | Strand | Sequence | SEQ ID NO |
|---|---|---|---|
| MTARC1-1986 | 19 mer Sense Strand | UUGACUAAACUUGAAAAAU | 358 |
| MTARC1-1988 | 19 mer Sense Strand | GACUAAACUUGAAAAAUGU | 359 |
| MTARC1-1989 | 19 mer Sense Strand | ACUAAACUUGAAAAAUGUU | 360 |
| MTARC1-1990 | 19 mer Sense Strand | CUAAACUUGAAAAAUGUUU | 361 |
| MTARC1-1995 | 19 mer Sense Strand | CUUGAAAAAUGUUUUUAAA | 362 |
| MTARC1-1996 | 19 mer Sense Strand | UUGAAAAAUGUUUUUAAAA | 363 |
| MTARC1-1998 | 19 mer Sense Strand | GAAAAAUGUUUUUAAAACU | 364 |
| MTARC1-1999 | 19 mer Sense Strand | AAAAAUGUUUUUAAAACUG | 365 |
| MTARC1-2000 | 19 mer Sense Strand | AAAAUGUUUUUAAAACUGU | 366 |
| MTARC1-2001 | 19 mer Sense Strand | AAAUGUUUUUAAAACUGUG | 367 |
| MTARC1-2002 | 19 mer Sense Strand | AAUGUUUUUAAAACUGUGA | 368 |
| MTARC1-2005 | 19 mer Sense Strand | GUUUUUAAAACUGUGAAUA | 369 |
| MTARC1-2006 | 19 mer Sense Strand | UUUUUAAAACUGUGAAUAA | 370 |
| MTARC1-2010 | 19 mer Sense Strand | UAAAACUGUGAAUAAAUGG | 371 |
| MTARC1-2011 | 19 mer Sense Strand | AAAACUGUGAAUAAAUGGA | 372 |
| MTARC1-2012 | 19 mer Sense Strand | AAACUGUGAAUAAAUGGAA | 373 |
| MTARC1-2013 | 19 mer Sense Strand | AACUGUGAAUAAAUGGAAG | 374 |
| MTARC1-2015 | 19 mer Sense Strand | CUGUGAAUAAAUGGAAGCU | 375 |
| MTARC1-2016 | 19 mer Sense Strand | UGUGAAUAAAUGGAAGCUA | 376 |
| MTARC1-2017 | 19 mer Sense Strand | GUGAAUAAAUGGAAGCUAC | 377 |
| MTARC1-2018 | 19 mer Sense Strand | UGAAUAAAUGGAAGCUACU | 378 |
| MTARC1-2019 | 19 mer Sense Strand | GAAUAAAUGGAAGCUACUU | 379 |
| MTARC1-2020 | 19 mer Sense Strand | AAUAAAUGGAAGCUACUUU | 380 |
| MTARC1-2022 | 19 mer Sense Strand | UAAAUGGAAGCUACUUUGA | 381 |
| MTARC1-2023 | 19 mer Sense Strand | AAAUGGAAGCUACUUUGAC | 382 |
| MTARC1-2025 | 19 mer Sense Strand | AUGGAAGCUACUUUGACUA | 383 |
| MTARC1-2027 | 19 mer Sense Strand | GGAAGCUACUUUGACUAGU | 384 |
| MTARC1-231 | 19 mer Anti-sense Strand | GGUAGAUCCAGAGCUGCGC | 385 |
| MTARC1-233 | 19 mer Anti-sense Strand | AGGGUAGAUCCAGAGCUGC | 386 |
| MTARC1-234 | 19 mer Anti-sense Strand | CAGGGUAGAUCCAGAGCUG | 387 |
| MTARC1-235 | 19 mer Anti-sense Strand | ACAGGGUAGAUCCAGAGCU | 388 |
| MTARC1-236 | 19 mer Anti-sense Strand | CACAGGGUAGAUCCAGAGC | 389 |
| MTARC1-237 | 19 mer Anti-sense Strand | UCACAGGGUAGAUCCAGAG | 390 |
| MTARC1-238 | 19 mer Anti-sense Strand | UUCACAGGGUAGAUCCAGA | 391 |
| MTARC1-239 | 19 mer Anti-sense Strand | UUUCACAGGGUAGAUCCAG | 392 |
| MTARC1-240 | 19 mer Anti-sense Strand | AUUUCACAGGGUAGAUCCA | 393 |

-continued

SEQUENCE LISTING

| Name | Strand | Sequence | SEQ ID NO |
|---|---|---|---|
| MTARC1-241 | 19 mer Anti-sense Strand | GAUUUCACAGGGUAGAUCC | 394 |
| MTARC1-242 | 19 mer Anti-sense Strand | GGAUUUCACAGGGUAGAUC | 395 |
| MTARC1-243 | 19 mer Anti-sense Strand | AGGAUUUCACAGGGUAGAU | 396 |
| MTARC1-244 | 19 mer Anti-sense Strand | CAGGAUUUCACAGGGUAGA | 397 |
| MTARC1-245 | 19 mer Anti-sense Strand | GCAGGAUUUCACAGGGUAG | 398 |
| MTARC1-247 | 19 mer Anti-sense Strand | UUGCAGGAUUUCACAGGGU | 399 |
| MTARC1-248 | 19 mer Anti-sense Strand | CUUGCAGGAUUUCACAGGG | 400 |
| MTARC1-249 | 19 mer Anti-sense Strand | CCUUGCAGGAUUUCACAGG | 401 |
| MTARC1-253 | 19 mer Anti-sense Strand | ACCCCCUUGCAGGAUUUCA | 402 |
| MTARC1-255 | 19 mer Anti-sense Strand | GCACCCCCUUGCAGGAUUU | 403 |
| MTARC1-318 | 19 mer Anti-sense Strand | AAAACCUGUCCCGCAGGUU | 404 |
| MTARC1-319 | 19 mer Anti-sense Strand | CAAAACCUGUCCCGCAGGU | 405 |
| MTARC1-320 | 19 mer Anti-sense Strand | CCAAAACCUGUCCCGCAGG | 406 |
| MTARC1-321 | 19 mer Anti-sense Strand | GCCAAAACCUGUCCCGCAG | 407 |
| MTARC1-323 | 19 mer Anti-sense Strand | AAGCCAAAACCUGUCCCGC | 408 |
| MTARC1-324 | 19 mer Anti-sense Strand | CAAGCCAAAACCUGUCCCG | 409 |
| MTARC1-325 | 19 mer Anti-sense Strand | ACAAGCCAAAACCUGUCCC | 410 |
| MTARC1-326 | 19 mer Anti-sense Strand | CACAAGCCAAAACCUGUCC | 411 |
| MTARC1-327 | 19 mer Anti-sense Strand | UCACAAGCCAAAACCUGUC | 412 |
| MTARC1-328 | 19 mer Anti-sense Strand | AUCACAAGCCAAAACCUGU | 413 |
| MTARC1-329 | 19 mer Anti-sense Strand | GAUCACAAGCCAAAACCUG | 414 |
| MTARC1-330 | 19 mer Anti-sense Strand | UGAUCACAAGCCAAAACCU | 415 |
| MTARC1-331 | 19 mer Anti-sense Strand | UUGAUCACAAGCCAAAACC | 416 |
| MTARC1-332 | 19 mer Anti-sense Strand | GUUGAUCACAAGCCAAAAC | 417 |
| MTARC1-334 | 19 mer Anti-sense Strand | UGGUUGAUCACAAGCCAAA | 418 |
| MTARC1-335 | 19 mer Anti-sense Strand | CUGGUUGAUCACAAGCCAA | 419 |
| MTARC1-337 | 19 mer Anti-sense Strand | UCCUGGUUGAUCACAAGCC | 420 |
| MTARC1-338 | 19 mer Anti-sense Strand | CUCCUGGUUGAUCACAAGC | 421 |
| MTARC1-339 | 19 mer Anti-sense Strand | CCUCCUGGUUGAUCACAAG | 422 |
| MTARC1-340 | 19 mer Anti-sense Strand | CCCUCCUGGUUGAUCACAA | 423 |
| MTARC1-341 | 19 mer Anti-sense Strand | UCCCUCCUGGUUGAUCACA | 424 |
| MTARC1-342 | 19 mer Anti-sense Strand | UUCCCUCCUGGUUGAUCAC | 425 |
| MTARC1-343 | 19 mer Anti-sense Strand | UUUCCCUCCUGGUUGAUCA | 426 |
| MTARC1-345 | 19 mer Anti-sense Strand | UGUUUCCCUCCUGGUUGAU | 427 |
| MTARC1-346 | 19 mer Anti-sense Strand | AUGUUUCCCUCCUGGUUGA | 428 |
| MTARC1-347 | 19 mer Anti-sense Strand | CAUGUUUCCCUCCUGGUUG | 429 |
| MTARC1-348 | 19 mer Anti-sense Strand | CCAUGUUUCCCUCCUGGUU | 430 |

-continued

SEQUENCE LISTING

| Name | Strand | Sequence | SEQ ID NO |
|---|---|---|---|
| MTARC1-349 | 19 mer Anti-sense Strand | ACCAUGUUUCCCUCCUGGU | 431 |
| MTARC1-350 | 19 mer Anti-sense Strand | AACCAUGUUUCCCUCCUGG | 432 |
| MTARC1-351 | 19 mer Anti-sense Strand | UAACCAUGUUUCCCUCCUG | 433 |
| MTARC1-352 | 19 mer Anti-sense Strand | GUAACCAUGUUUCCCUCCU | 434 |
| MTARC1-353 | 19 mer Anti-sense Strand | AGUAACCAUGUUUCCCUCC | 435 |
| MTARC1-354 | 19 mer Anti-sense Strand | CAGUAACCAUGUUUCCCUC | 436 |
| MTARC1-356 | 19 mer Anti-sense Strand | AGCAGUAACCAUGUUUCCC | 437 |
| MTARC1-357 | 19 mer Anti-sense Strand | GAGCAGUAACCAUGUUUCC | 438 |
| MTARC1-358 | 19 mer Anti-sense Strand | CGAGCAGUAACCAUGUUUC | 439 |
| MTARC1-359 | 19 mer Anti-sense Strand | GCGAGCAGUAACCAUGUUU | 440 |
| MTARC1-360 | 19 mer Anti-sense Strand | GGCGAGCAGUAACCAUGUU | 441 |
| MTARC1-361 | 19 mer Anti-sense Strand | UGGCGAGCAGUAACCAUGU | 442 |
| MTARC1-362 | 19 mer Anti-sense Strand | CUGGCGAGCAGUAACCAUG | 443 |
| MTARC1-365 | 19 mer Anti-sense Strand | UUCCUGGCGAGCAGUAACC | 444 |
| MTARC1-376 | 19 mer Anti-sense Strand | ACCAGGCGAGGUUCCUGGC | 445 |
| MTARC1-379 | 19 mer Anti-sense Strand | AGGACCAGGCGAGGUUCCU | 446 |
| MTARC1-384 | 19 mer Anti-sense Strand | AAAUCAGGACCAGGCGAGG | 447 |
| MTARC1-385 | 19 mer Anti-sense Strand | GAAAUCAGGACCAGGCGAG | 448 |
| MTARC1-388 | 19 mer Anti-sense Strand | AGGGAAAUCAGGACCAGGC | 449 |
| MTARC1-390 | 19 mer Anti-sense Strand | UCAGGGAAAUCAGGACCAG | 450 |
| MTARC1-391 | 19 mer Anti-sense Strand | GUCAGGGAAAUCAGGACCA | 451 |
| MTARC1-393 | 19 mer Anti-sense Strand | AGGUCAGGGAAAUCAGGAC | 452 |
| MTARC1-395 | 19 mer Anti-sense Strand | GCAGGUCAGGGAAAUCAGG | 453 |
| MTARC1-405 | 19 mer Anti-sense Strand | UGUCACCAUCGCAGGUCAG | 454 |
| MTARC1-409 | 19 mer Anti-sense Strand | AGGGUGUCACCAUCGCAGG | 455 |
| MTARC1-411 | 19 mer Anti-sense Strand | UCAGGGUGUCACCAUCGCA | 456 |
| MTARC1-412 | 19 mer Anti-sense Strand | GUCAGGGUGUCACCAUCGC | 457 |
| MTARC1-413 | 19 mer Anti-sense Strand | AGUCAGGGUGUCACCAUCG | 458 |
| MTARC1-414 | 19 mer Anti-sense Strand | GAGUCAGGGUGUCACCAUC | 459 |
| MTARC1-415 | 19 mer Anti-sense Strand | AGAGUCAGGGUGUCACCAU | 460 |
| MTARC1-416 | 19 mer Anti-sense Strand | GAGAGUCAGGGUGUCACCA | 461 |
| MTARC1-417 | 19 mer Anti-sense Strand | UGAGAGUCAGGGUGUCACC | 462 |
| MTARC1-418 | 19 mer Anti-sense Strand | CUGAGAGUCAGGGUGUCAC | 463 |
| MTARC1-419 | 19 mer Anti-sense Strand | ACUGAGAGUCAGGGUGUCA | 464 |
| MTARC1-420 | 19 mer Anti-sense Strand | CACUGAGAGUCAGGGUGUC | 465 |
| MTARC1-421 | 19 mer Anti-sense Strand | GCACUGAGAGUCAGGGUGU | 466 |

SEQUENCE LISTING

| Name | Strand | Sequence | SEQ ID NO |
|---|---|---|---|
| MTARC1-422 | 19 mer Anti-sense Strand | UGCACUGAGAGUCAGGGUG | 467 |
| MTARC1-423 | 19 mer Anti-sense Strand | CUGCACUGAGAGUCAGGGU | 468 |
| MTARC1-424 | 19 mer Anti-sense Strand | GCUGCACUGAGAGUCAGGG | 469 |
| MTARC1-425 | 19 mer Anti-sense Strand | GGCUGCACUGAGAGUCAGG | 470 |
| MTARC1-426 | 19 mer Anti-sense Strand | AGGCUGCACUGAGAGUCAG | 471 |
| MTARC1-427 | 19 mer Anti-sense Strand | UAGGCUGCACUGAGAGUCA | 472 |
| MTARC1-428 | 19 mer Anti-sense Strand | GUAGGCUGCACUGAGAGUC | 473 |
| MTARC1-429 | 19 mer Anti-sense Strand | UGUAGGCUGCACUGAGAGU | 474 |
| MTARC1-430 | 19 mer Anti-sense Strand | GUGUAGGCUGCACUGAGAG | 475 |
| MTARC1-431 | 19 mer Anti-sense Strand | UGUGUAGGCUGCACUGAGA | 476 |
| MTARC1-433 | 19 mer Anti-sense Strand | UUUGUGUAGGCUGCACUGA | 477 |
| MTARC1-434 | 19 mer Anti-sense Strand | CUUUGUGUAGGCUGCACUG | 478 |
| MTARC1-435 | 19 mer Anti-sense Strand | CCUUUGUGUAGGCUGCACU | 479 |
| MTARC1-436 | 19 mer Anti-sense Strand | UCCUUUGUGUAGGCUGCAC | 480 |
| MTARC1-437 | 19 mer Anti-sense Strand | GUCCUUUGUGUAGGCUGCA | 481 |
| MTARC1-438 | 19 mer Anti-sense Strand | GGUCCUUUGUGUAGGCUGC | 482 |
| MTARC1-439 | 19 mer Anti-sense Strand | AGGUCCUUUGUGUAGGCUG | 483 |
| MTARC1-440 | 19 mer Anti-sense Strand | UAGGUCCUUUGUGUAGGCU | 484 |
| MTARC1-441 | 19 mer Anti-sense Strand | GUAGGUCCUUUGUGUAGGC | 485 |
| MTARC1-445 | 19 mer Anti-sense Strand | AGUAGUAGGUCCUUUGUGU | 486 |
| MTARC1-446 | 19 mer Anti-sense Strand | CAGUAGUAGGUCCUUUGUG | 487 |
| MTARC1-447 | 19 mer Anti-sense Strand | GCAGUAGUAGGUCCUUUGU | 488 |
| MTARC1-448 | 19 mer Anti-sense Strand | GGCAGUAGUAGGUCCUUUG | 489 |
| MTARC1-449 | 19 mer Anti-sense Strand | AGGCAGUAGUAGGUCCUUU | 490 |
| MTARC1-450 | 19 mer Anti-sense Strand | UAGGCAGUAGUAGGUCCUU | 491 |
| MTARC1-451 | 19 mer Anti-sense Strand | AUAGGCAGUAGUAGGUCCU | 492 |
| MTARC1-452 | 19 mer Anti-sense Strand | GAUAGGCAGUAGUAGGUCC | 493 |
| MTARC1-453 | 19 mer Anti-sense Strand | UGAUAGGCAGUAGUAGGUC | 494 |
| MTARC1-454 | 19 mer Anti-sense Strand | UUGAUAGGCAGUAGUAGGU | 495 |
| MTARC1-456 | 19 mer Anti-sense Strand | UUUUGAUAGGCAGUAGUAG | 496 |
| MTARC1-457 | 19 mer Anti-sense Strand | GUUUUGAUAGGCAGUAGUA | 497 |
| MTARC1-458 | 19 mer Anti-sense Strand | CGUUUUGAUAGGCAGUAGU | 498 |
| MTARC1-459 | 19 mer Anti-sense Strand | GCGUUUUGAUAGGCAGUAG | 499 |
| MTARC1-460 | 19 mer Anti-sense Strand | GGCGUUUUGAUAGGCAGUA | 500 |
| MTARC1-462 | 19 mer Anti-sense Strand | UGGGCGUUUUGAUAGGCAG | 501 |
| MTARC1-468 | 19 mer Anti-sense Strand | UUGUGGUGGGCGUUUUGAU | 502 |
| MTARC1-469 | 19 mer Anti-sense Strand | UUUGUGGUGGGCGUUUUGA | 503 |

-continued

SEQUENCE LISTING

| Name | Strand | Sequence | SEQ ID NO |
|---|---|---|---|
| MTARC1-470 | 19 mer Anti-sense Strand | AUUUGUGGUGGGCGUUUUG | 504 |
| MTARC1-471 | 19 mer Anti-sense Strand | CAUUUGUGGUGGGCGUUUU | 505 |
| MTARC1-473 | 19 mer Anti-sense Strand | UGCAUUUGUGGUGGGCGUU | 506 |
| MTARC1-475 | 19 mer Anti-sense Strand | ACUGCAUUUGUGGUGGGCG | 507 |
| MTARC1-476 | 19 mer Anti-sense Strand | CACUGCAUUUGUGGUGGGC | 508 |
| MTARC1-482 | 19 mer Anti-sense Strand | CUUGUGCACUGCAUUUGUG | 509 |
| MTARC1-483 | 19 mer Anti-sense Strand | ACUUGUGCACUGCAUUUGU | 510 |
| MTARC1-484 | 19 mer Anti-sense Strand | CACUUGUGCACUGCAUUUG | 511 |
| MTARC1-552 | 19 mer Anti-sense Strand | AGCUGGUUAUCCACUGGGC | 512 |
| MTARC1-553 | 19 mer Anti-sense Strand | AAGCUGGUUAUCCACUGGG | 513 |
| MTARC1-554 | 19 mer Anti-sense Strand | GAAGCUGGUUAUCCACUGG | 514 |
| MTARC1-555 | 19 mer Anti-sense Strand | GGAAGCUGGUUAUCCACUG | 515 |
| MTARC1-556 | 19 mer Anti-sense Strand | AGGAAGCUGGUUAUCCACU | 516 |
| MTARC1-557 | 19 mer Anti-sense Strand | CAGGAAGCUGGUUAUCCAC | 517 |
| MTARC1-558 | 19 mer Anti-sense Strand | UCAGGAAGCUGGUUAUCCA | 518 |
| MTARC1-559 | 19 mer Anti-sense Strand | UUCAGGAAGCUGGUUAUCC | 519 |
| MTARC1-560 | 19 mer Anti-sense Strand | CUUCAGGAAGCUGGUUAUC | 520 |
| MTARC1-561 | 19 mer Anti-sense Strand | ACUUCAGGAAGCUGGUUAU | 521 |
| MTARC1-562 | 19 mer Anti-sense Strand | GACUUCAGGAAGCUGGUUA | 522 |
| MTARC1-563 | 19 mer Anti-sense Strand | UGACUUCAGGAAGCUGGUU | 523 |
| MTARC1-564 | 19 mer Anti-sense Strand | GUGACUUCAGGAAGCUGGU | 524 |
| MTARC1-565 | 19 mer Anti-sense Strand | UGUGACUUCAGGAAGCUGG | 525 |
| MTARC1-566 | 19 mer Anti-sense Strand | CUGUGACUUCAGGAAGCUG | 526 |
| MTARC1-567 | 19 mer Anti-sense Strand | GCUGUGACUUCAGGAAGCU | 527 |
| MTARC1-568 | 19 mer Anti-sense Strand | GGCUGUGACUUCAGGAAGC | 528 |
| MTARC1-589 | 19 mer Anti-sense Strand | UCGAAGUGCACCAGGCGGU | 529 |
| MTARC1-591 | 19 mer Anti-sense Strand | GCUCGAAGUGCACCAGGCG | 530 |
| MTARC1-592 | 19 mer Anti-sense Strand | GGCUCGAAGUGCACCAGGC | 531 |
| MTARC1-593 | 19 mer Anti-sense Strand | AGGCUCGAAGUGCACCAGG | 532 |
| MTARC1-597 | 19 mer Anti-sense Strand | UGUGAGGCUCGAAGUGCAC | 533 |
| MTARC1-600 | 19 mer Anti-sense Strand | GCAUGUGAGGCUCGAAGUG | 534 |
| MTARC1-612 | 19 mer Anti-sense Strand | GACGUCUCGGUCGCAUGUG | 535 |
| MTARC1-614 | 19 mer Anti-sense Strand | AGGACGUCUCGGUCGCAUG | 536 |
| MTARC1-617 | 19 mer Anti-sense Strand | AUGAGGACGUCUCGGUCGC | 537 |
| MTARC1-618 | 19 mer Anti-sense Strand | GAUGAGGACGUCUCGGUCG | 538 |
| MTARC1-620 | 19 mer Anti-sense Strand | UUGAUGAGGACGUCUCGGU | 539 |

-continued

SEQUENCE LISTING

| Name | Strand | Sequence | SEQ ID NO |
|---|---|---|---|
| MTARC1-621 | 19 mer Anti-sense Strand | UUUGAUGAGGACGUCUCGG | 540 |
| MTARC1-622 | 19 mer Anti-sense Strand | AUUUGAUGAGGACGUCUCG | 541 |
| MTARC1-623 | 19 mer Anti-sense Strand | UAUUUGAUGAGGACGUCUC | 542 |
| MTARC1-624 | 19 mer Anti-sense Strand | CUAUUUGAUGAGGACGUCU | 543 |
| MTARC1-625 | 19 mer Anti-sense Strand | GCUAUUUGAUGAGGACGUC | 544 |
| MTARC1-626 | 19 mer Anti-sense Strand | UGCUAUUUGAUGAGGACGU | 545 |
| MTARC1-627 | 19 mer Anti-sense Strand | CUGCUAUUUGAUGAGGACG | 546 |
| MTARC1-628 | 19 mer Anti-sense Strand | UCUGCUAUUUGAUGAGGAC | 547 |
| MTARC1-629 | 19 mer Anti-sense Strand | GUCUGCUAUUUGAUGAGGA | 548 |
| MTARC1-630 | 19 mer Anti-sense Strand | AGUCUGCUAUUUGAUGAGG | 549 |
| MTARC1-631 | 19 mer Anti-sense Strand | AAGUCUGCUAUUUGAUGAG | 550 |
| MTARC1-632 | 19 mer Anti-sense Strand | CAAGUCUGCUAUUUGAUGA | 551 |
| MTARC1-633 | 19 mer Anti-sense Strand | ACAAGUCUGCUAUUUGAUG | 552 |
| MTARC1-634 | 19 mer Anti-sense Strand | AACAAGUCUGCUAUUUGAU | 553 |
| MTARC1-635 | 19 mer Anti-sense Strand | GAACAAGUCUGCUAUUUGA | 554 |
| MTARC1-636 | 19 mer Anti-sense Strand | GGAACAAGUCUGCUAUUUG | 555 |
| MTARC1-637 | 19 mer Anti-sense Strand | CGGAACAAGUCUGCUAUUU | 556 |
| MTARC1-638 | 19 mer Anti-sense Strand | UCGGAACAAGUCUGCUAUU | 557 |
| MTARC1-639 | 19 mer Anti-sense Strand | GUCGGAACAAGUCUGCUAU | 558 |
| MTARC1-640 | 19 mer Anti-sense Strand | GGUCGGAACAAGUCUGCUA | 559 |
| MTARC1-641 | 19 mer Anti-sense Strand | GGGUCGGAACAAGUCUGCU | 560 |
| MTARC1-642 | 19 mer Anti-sense Strand | UGGGUCGGAACAAGUCUGC | 561 |
| MTARC1-643 | 19 mer Anti-sense Strand | UUGGGUCGGAACAAGUCUG | 562 |
| MTARC1-644 | 19 mer Anti-sense Strand | CUUGGGUCGGAACAAGUCU | 563 |
| MTARC1-645 | 19 mer Anti-sense Strand | CCUUGGGUCGGAACAAGUC | 564 |
| MTARC1-646 | 19 mer Anti-sense Strand | UCCUUGGGUCGGAACAAGU | 565 |
| MTARC1-647 | 19 mer Anti-sense Strand | GUCCUUGGGUCGGAACAAG | 566 |
| MTARC1-648 | 19 mer Anti-sense Strand | GGUCCUUGGGUCGGAACAA | 567 |
| MTARC1-649 | 19 mer Anti-sense Strand | UGGUCCUUGGGUCGGAACA | 568 |
| MTARC1-650 | 19 mer Anti-sense Strand | CUGGUCCUUGGGUCGGAAC | 569 |
| MTARC1-651 | 19 mer Anti-sense Strand | UCUGGUCCUUGGGUCGGAA | 570 |
| MTARC1-652 | 19 mer Anti-sense Strand | AUCUGGUCCUUGGGUCGGA | 571 |
| MTARC1-653 | 19 mer Anti-sense Strand | AAUCUGGUCCUUGGGUCGG | 572 |
| MTARC1-654 | 19 mer Anti-sense Strand | CAAUCUGGUCCUUGGGUCG | 573 |
| MTARC1-655 | 19 mer Anti-sense Strand | GCAAUCUGGUCCUUGGGUC | 574 |
| MTARC1-656 | 19 mer Anti-sense Strand | AGCAAUCUGGUCCUUGGGU | 575 |
| MTARC1-657 | 19 mer Anti-sense Strand | AAGCAAUCUGGUCCUUGGG | 576 |

SEQUENCE LISTING

| Name | Strand | Sequence | SEQ ID NO |
|---|---|---|---|
| MTARC1-658 | 19 mer Anti-sense Strand | UAAGCAAUCUGGUCCUUGG | 577 |
| MTARC1-659 | 19 mer Anti-sense Strand | GUAAGCAAUCUGGUCCUUG | 578 |
| MTARC1-660 | 19 mer Anti-sense Strand | AGUAAGCAAUCUGGUCCUU | 579 |
| MTARC1-661 | 19 mer Anti-sense Strand | GAGUAAGCAAUCUGGUCCU | 580 |
| MTARC1-662 | 19 mer Anti-sense Strand | UGAGUAAGCAAUCUGGUCC | 581 |
| MTARC1-663 | 19 mer Anti-sense Strand | CUGAGUAAGCAAUCUGGUC | 582 |
| MTARC1-664 | 19 mer Anti-sense Strand | UCUGAGUAAGCAAUCUGGU | 583 |
| MTARC1-665 | 19 mer Anti-sense Strand | GUCUGAGUAAGCAAUCUGG | 584 |
| MTARC1-666 | 19 mer Anti-sense Strand | UGUCUGAGUAAGCAAUCUG | 585 |
| MTARC1-667 | 19 mer Anti-sense Strand | GUGUCUGAGUAAGCAAUCU | 586 |
| MTARC1-668 | 19 mer Anti-sense Strand | GGUGUCUGAGUAAGCAAUC | 587 |
| MTARC1-669 | 19 mer Anti-sense Strand | UGGUGUCUGAGUAAGCAAU | 588 |
| MTARC1-670 | 19 mer Anti-sense Strand | CUGGUGUCUGAGUAAGCAA | 589 |
| MTARC1-671 | 19 mer Anti-sense Strand | GCUGGUGUCUGAGUAAGCA | 590 |
| MTARC1-672 | 19 mer Anti-sense Strand | GGCUGGUGUCUGAGUAAGC | 591 |
| MTARC1-673 | 19 mer Anti-sense Strand | GGGCUGGUGUCUGAGUAAG | 592 |
| MTARC1-674 | 19 mer Anti-sense Strand | UGGGCUGGUGUCUGAGUAA | 593 |
| MTARC1-675 | 19 mer Anti-sense Strand | AUGGGCUGGUGUCUGAGUA | 594 |
| MTARC1-676 | 19 mer Anti-sense Strand | AAUGGGCUGGUGUCUGAGU | 595 |
| MTARC1-677 | 19 mer Anti-sense Strand | GAAUGGGCUGGUGUCUGAG | 596 |
| MTARC1-678 | 19 mer Anti-sense Strand | AGAAUGGGCUGGUGUCUGA | 597 |
| MTARC1-679 | 19 mer Anti-sense Strand | AAGAAUGGGCUGGUGUCUG | 598 |
| MTARC1-680 | 19 mer Anti-sense Strand | CAAGAAUGGGCUGGUGUCU | 599 |
| MTARC1-681 | 19 mer Anti-sense Strand | UCAAGAAUGGGCUGGUGUC | 600 |
| MTARC1-682 | 19 mer Anti-sense Strand | AUCAAGAAUGGGCUGGUGU | 601 |
| MTARC1-683 | 19 mer Anti-sense Strand | GAUCAAGAAUGGGCUGGUG | 602 |
| MTARC1-684 | 19 mer Anti-sense Strand | GGAUCAAGAAUGGGCUGGU | 603 |
| MTARC1-685 | 19 mer Anti-sense Strand | AGGAUCAAGAAUGGGCUGG | 604 |
| MTARC1-686 | 19 mer Anti-sense Strand | AAGGAUCAAGAAUGGGCUG | 605 |
| MTARC1-687 | 19 mer Anti-sense Strand | AAAGGAUCAAGAAUGGGCU | 606 |
| MTARC1-691 | 19 mer Anti-sense Strand | UCAGAAAGGAUCAAGAAUG | 607 |
| MTARC1-692 | 19 mer Anti-sense Strand | CUCAGAAAGGAUCAAGAAU | 608 |
| MTARC1-724 | 19 mer Anti-sense Strand | UCUAGCCUGGAGUUGAGAU | 609 |
| MTARC1-726 | 19 mer Anti-sense Strand | UCUCUAGCCUGGAGUUGAG | 610 |
| MTARC1-728 | 19 mer Anti-sense Strand | CUUCUCUAGCCUGGAGUUG | 611 |
| MTARC1-729 | 19 mer Anti-sense Strand | UCUUCUCUAGCCUGGAGUU | 612 |

-continued

SEQUENCE LISTING

| Name | Strand | Sequence | SEQ ID NO |
|---|---|---|---|
| MTARC1-730 | 19 mer Anti-sense Strand | UUCUUCUCUAGCCUGGAGU | 613 |
| MTARC1-731 | 19 mer Anti-sense Strand | UUUCUUCUCUAGCCUGGAG | 614 |
| MTARC1-733 | 19 mer Anti-sense Strand | ACUUUCUUCUCUAGCCUGG | 615 |
| MTARC1-734 | 19 mer Anti-sense Strand | AACUUUCUUCUCUAGCCUG | 616 |
| MTARC1-735 | 19 mer Anti-sense Strand | UAACUUUCUUCUCUAGCCU | 617 |
| MTARC1-736 | 19 mer Anti-sense Strand | UUAACUUUCUUCUCUAGCC | 618 |
| MTARC1-737 | 19 mer Anti-sense Strand | UUUAACUUUCUUCUCUAGC | 619 |
| MTARC1-738 | 19 mer Anti-sense Strand | CUUUAACUUUCUUCUCUAG | 620 |
| MTARC1-739 | 19 mer Anti-sense Strand | GCUUUAACUUUCUUCUCUA | 621 |
| MTARC1-740 | 19 mer Anti-sense Strand | UGCUUUAACUUUCUUCUCU | 622 |
| MTARC1-741 | 19 mer Anti-sense Strand | UUGCUUUAACUUUCUUCUC | 623 |
| MTARC1-742 | 19 mer Anti-sense Strand | GUUGCUUUAACUUUCUUCU | 624 |
| MTARC1-743 | 19 mer Anti-sense Strand | GGUUGCUUUAACUUUCUUC | 625 |
| MTARC1-744 | 19 mer Anti-sense Strand | UGGUUGCUUUAACUUUCUU | 626 |
| MTARC1-745 | 19 mer Anti-sense Strand | UUGGUUGCUUUAACUUUCU | 627 |
| MTARC1-746 | 19 mer Anti-sense Strand | GUUGGUUGCUUUAACUUUC | 628 |
| MTARC1-747 | 19 mer Anti-sense Strand | AGUUGGUUGCUUUAACUUU | 629 |
| MTARC1-748 | 19 mer Anti-sense Strand | AAGUUGGUUGCUUUAACUU | 630 |
| MTARC1-750 | 19 mer Anti-sense Strand | UGAAGUUGGUUGCUUUAAC | 631 |
| MTARC1-751 | 19 mer Anti-sense Strand | CUGAAGUUGGUUGCUUUAA | 632 |
| MTARC1-752 | 19 mer Anti-sense Strand | CCUGAAGUUGGUUGCUUUA | 633 |
| MTARC1-753 | 19 mer Anti-sense Strand | GCCUGAAGUUGGUUGCUUU | 634 |
| MTARC1-754 | 19 mer Anti-sense Strand | GGCCUGAAGUUGGUUGCUU | 635 |
| MTARC1-755 | 19 mer Anti-sense Strand | GGGCCUGAAGUUGGUUGCU | 636 |
| MTARC1-756 | 19 mer Anti-sense Strand | UGGGCCUGAAGUUGGUUGC | 637 |
| MTARC1-758 | 19 mer Anti-sense Strand | AUUGGGCCUGAAGUUGGUU | 638 |
| MTARC1-759 | 19 mer Anti-sense Strand | UAUUGGGCCUGAAGUUGGU | 639 |
| MTARC1-760 | 19 mer Anti-sense Strand | AUAUUGGGCCUGAAGUUGG | 640 |
| MTARC1-761 | 19 mer Anti-sense Strand | AAUAUUGGGCCUGAAGUUG | 641 |
| MTARC1-762 | 19 mer Anti-sense Strand | CAAUAUUGGGCCUGAAGUU | 642 |
| MTARC1-763 | 19 mer Anti-sense Strand | ACAAUAUUGGGCCUGAAGU | 643 |
| MTARC1-764 | 19 mer Anti-sense Strand | UACAAUAUUGGGCCUGAAG | 644 |
| MTARC1-765 | 19 mer Anti-sense Strand | UUACAAUAUUGGGCCUGAA | 645 |
| MTARC1-766 | 19 mer Anti-sense Strand | AUUACAAUAUUGGGCCUGA | 646 |
| MTARC1-767 | 19 mer Anti-sense Strand | AAUUACAAUAUUGGGCCUG | 647 |
| MTARC1-768 | 19 mer Anti-sense Strand | AAAUUACAAUAUUGGGCCU | 648 |
| MTARC1-769 | 19 mer Anti-sense Strand | GAAAUUACAAUAUUGGGCC | 649 |

-continued

SEQUENCE LISTING

| Name | Strand | Sequence | SEQ ID NO |
|---|---|---|---|
| MTARC1-770 | 19 mer Anti-sense Strand | UGAAAUUACAAUAUUGGGC | 650 |
| MTARC1-771 | 19 mer Anti-sense Strand | CUGAAAUUACAAUAUUGGG | 651 |
| MTARC1-772 | 19 mer Anti-sense Strand | CCUGAAAUUACAAUAUUGG | 652 |
| MTARC1-773 | 19 mer Anti-sense Strand | UCCUGAAAUUACAAUAUUG | 653 |
| MTARC1-774 | 19 mer Anti-sense Strand | AUCCUGAAAUUACAAUAUU | 654 |
| MTARC1-775 | 19 mer Anti-sense Strand | CAUCCUGAAAUUACAAUAU | 655 |
| MTARC1-776 | 19 mer Anti-sense Strand | GCAUCCUGAAAUUACAAUA | 656 |
| MTARC1-777 | 19 mer Anti-sense Strand | CGCAUCCUGAAAUUACAAU | 657 |
| MTARC1-778 | 19 mer Anti-sense Strand | UCGCAUCCUGAAAUUACAA | 658 |
| MTARC1-779 | 19 mer Anti-sense Strand | AUCGCAUCCUGAAAUUACA | 659 |
| MTARC1-780 | 19 mer Anti-sense Strand | CAUCGCAUCCUGAAAUUAC | 660 |
| MTARC1-781 | 19 mer Anti-sense Strand | ACAUCGCAUCCUGAAAUUA | 661 |
| MTARC1-782 | 19 mer Anti-sense Strand | GACAUCGCAUCCUGAAAUU | 662 |
| MTARC1-783 | 19 mer Anti-sense Strand | AGACAUCGCAUCCUGAAAU | 663 |
| MTARC1-784 | 19 mer Anti-sense Strand | UAGACAUCGCAUCCUGAAA | 664 |
| MTARC1-785 | 19 mer Anti-sense Strand | AUAGACAUCGCAUCCUGAA | 665 |
| MTARC1-786 | 19 mer Anti-sense Strand | CAUAGACAUCGCAUCCUGA | 666 |
| MTARC1-787 | 19 mer Anti-sense Strand | GCAUAGACAUCGCAUCCUG | 667 |
| MTARC1-788 | 19 mer Anti-sense Strand | UGCAUAGACAUCGCAUCCU | 668 |
| MTARC1-789 | 19 mer Anti-sense Strand | CUGCAUAGACAUCGCAUCC | 669 |
| MTARC1-790 | 19 mer Anti-sense Strand | UCUGCAUAGACAUCGCAUC | 670 |
| MTARC1-791 | 19 mer Anti-sense Strand | CUCUGCAUAGACAUCGCAU | 671 |
| MTARC1-792 | 19 mer Anti-sense Strand | CCUCUGCAUAGACAUCGCA | 672 |
| MTARC1-863 | 19 mer Anti-sense Strand | UAAAAUGCAUCUGGAACAA | 673 |
| MTARC1-929 | 19 mer Anti-sense Strand | AUAACUCUUCAGUGUUUCC | 674 |
| MTARC1-930 | 19 mer Anti-sense Strand | GAUAACUCUUCAGUGUUUC | 675 |
| MTARC1-934 | 19 mer Anti-sense Strand | UGGCGAUAACUCUUCAGUG | 676 |
| MTARC1-955 | 19 mer Anti-sense Strand | UUUCGUUCUGAAGGGUCAC | 677 |
| MTARC1-959 | 19 mer Anti-sense Strand | UAACUUUCGUUCUGAAGGG | 678 |
| MTARC1-960 | 19 mer Anti-sense Strand | AUAACUUUCGUUCUGAAGG | 679 |
| MTARC1-963 | 19 mer Anti-sense Strand | CAUAUAACUUUCGUUCUGA | 680 |
| MTARC1-964 | 19 mer Anti-sense Strand | CCAUAUAACUUUCGUUCUG | 681 |
| MTARC1-965 | 19 mer Anti-sense Strand | UCCAUAUAACUUUCGUUCU | 682 |
| MTARC1-966 | 19 mer Anti-sense Strand | UUCCAUAUAACUUUCGUUC | 683 |
| MTARC1-967 | 19 mer Anti-sense Strand | UUUCCAUAUAACUUUCGUU | 684 |
| MTARC1-969 | 19 mer Anti-sense Strand | AUUUUCCAUAUAACUUUCG | 685 |

SEQUENCE LISTING

| Name | Strand | Sequence | SEQ ID NO |
|---|---|---|---|
| MTARC1-970 | 19 mer Anti-sense Strand | GAUUUUCCAUAUAACUUUC | 686 |
| MTARC1-971 | 19 mer Anti-sense Strand | UGAUUUUCCAUAUAACUUU | 687 |
| MTARC1-1107 | 19 mer Anti-sense Strand | CAUUUUUGAGAACAUUUUU | 688 |
| MTARC1-1113 | 19 mer Anti-sense Strand | UGUUGUCAUUUUUGAGAAC | 689 |
| MTARC1-1118 | 19 mer Anti-sense Strand | UCAAGUGUUGUCAUUUUUG | 690 |
| MTARC1-1123 | 19 mer Anti-sense Strand | AUGCUUCAAGUGUUGUCAU | 691 |
| MTARC1-1126 | 19 mer Anti-sense Strand | ACCAUGCUUCAAGUGUUGU | 692 |
| MTARC1-1127 | 19 mer Anti-sense Strand | CACCAUGCUUCAAGUGUUG | 693 |
| MTARC1-1128 | 19 mer Anti-sense Strand | ACACCAUGCUUCAAGUGUU | 694 |
| MTARC1-1129 | 19 mer Anti-sense Strand | AACACCAUGCUUCAAGUGU | 695 |
| MTARC1-1130 | 19 mer Anti-sense Strand | AAACACCAUGCUUCAAGUG | 696 |
| MTARC1-1132 | 19 mer Anti-sense Strand | UGAAACACCAUGCUUCAAG | 697 |
| MTARC1-1133 | 19 mer Anti-sense Strand | CUGAAACACCAUGCUUCAA | 698 |
| MTARC1-1134 | 19 mer Anti-sense Strand | UCUGAAACACCAUGCUUCA | 699 |
| MTARC1-1135 | 19 mer Anti-sense Strand | UUCUGAAACACCAUGCUUC | 700 |
| MTARC1-1139 | 19 mer Anti-sense Strand | UCAGUUCUGAAACACCAUG | 701 |
| MTARC1-1144 | 19 mer Anti-sense Strand | AGGUCUCAGUUCUGAAACA | 702 |
| MTARC1-1165 | 19 mer Anti-sense Strand | ACAAAUUUAAAGAAAAUGU | 703 |
| MTARC1-1167 | 19 mer Anti-sense Strand | UCACAAAUUUAAAGAAAAU | 704 |
| MTARC1-1173 | 19 mer Anti-sense Strand | UGAAAAUCACAAAUUUAAA | 705 |
| MTARC1-1177 | 19 mer Anti-sense Strand | AAUGUGAAAAUCACAAAUU | 706 |
| MTARC1-1179 | 19 mer Anti-sense Strand | AAAAUGUGAAAAUCACAAA | 707 |
| MTARC1-1329 | 19 mer Anti-sense Strand | AUUCCAUAAUCAGUUAAAC | 708 |
| MTARC1-1330 | 19 mer Anti-sense Strand | UAUUCCAUAAUCAGUUAAA | 709 |
| MTARC1-1332 | 19 mer Anti-sense Strand | ACUAUUCCAUAAUCAGUUA | 710 |
| MTARC1-1333 | 19 mer Anti-sense Strand | AACUAUUCCAUAAUCAGUU | 711 |
| MTARC1-1334 | 19 mer Anti-sense Strand | GAACUAUUCCAUAAUCAGU | 712 |
| MTARC1-1335 | 19 mer Anti-sense Strand | AGAACUAUUCCAUAAUCAG | 713 |
| MTARC1-1620 | 19 mer Anti-sense Strand | UAUGGAAAAUUAAUAUCUG | 714 |
| MTARC1-1622 | 19 mer Anti-sense Strand | UCUAUGGAAAAUUAAUAUC | 715 |
| MTARC1-1660 | 19 mer Anti-sense Strand | UCCAAUGCUGUCUGAGAAG | 716 |
| MTARC1-1663 | 19 mer Anti-sense Strand | AAAUCCAAUGCUGUCUGAG | 717 |
| MTARC1-1664 | 19 mer Anti-sense Strand | GAAAUCCAAUGCUGUCUGA | 718 |
| MTARC1-1812 | 19 mer Anti-sense Strand | AUCACUGAAUCACUUUUCU | 719 |
| MTARC1-1816 | 19 mer Anti-sense Strand | UGAAAUCACUGAAUCACUU | 720 |
| MTARC1-1868 | 19 mer Anti-sense Strand | CAACUGACAUAUGCUUUCC | 721 |
| MTARC1-1869 | 19 mer Anti-sense Strand | ACAACUGACAUAUGCUUUC | 722 |

SEQUENCE LISTING

| Name | Strand | Sequence | SEQ ID NO |
|---|---|---|---|
| MTARC1-1876 | 19 mer Anti-sense Strand | GUUUUAAACAACUGACAUA | 723 |
| MTARC1-1877 | 19 mer Anti-sense Strand | GGUUUUAAACAACUGACAU | 724 |
| MTARC1-1878 | 19 mer Anti-sense Strand | GGGUUUUAAACAACUGACA | 725 |
| MTARC1-1879 | 19 mer Anti-sense Strand | UGGGUUUUAAACAACUGAC | 726 |
| MTARC1-1882 | 19 mer Anti-sense Strand | UAUUGGGUUUUAAACAACU | 727 |
| MTARC1-1883 | 19 mer Anti-sense Strand | AUAUUGGGUUUUAAACAAC | 728 |
| MTARC1-1884 | 19 mer Anti-sense Strand | GAUAUUGGGUUUUAAACAA | 729 |
| MTARC1-1885 | 19 mer Anti-sense Strand | AGAUAUUGGGUUUUAAACA | 730 |
| MTARC1-1886 | 19 mer Anti-sense Strand | UAGAUAUUGGGUUUUAAAC | 731 |
| MTARC1-1935 | 19 mer Anti-sense Strand | UAAAAAAUAUACUUCAUCA | 732 |
| MTARC1-1936 | 19 mer Anti-sense Strand | AUAAAAAAUAUACUUCAUC | 733 |
| MTARC1-1937 | 19 mer Anti-sense Strand | AAUAAAAAAUAUACUUCAU | 734 |
| MTARC1-1939 | 19 mer Anti-sense Strand | GCAAUAAAAAAUAUACUUC | 735 |
| MTARC1-1941 | 19 mer Anti-sense Strand | UGGCAAUAAAAAAUAUACU | 736 |
| MTARC1-1953 | 19 mer Anti-sense Strand | CAAAGGACAAAAUGGCAAU | 737 |
| MTARC1-1955 | 19 mer Anti-sense Strand | AUCAAAGGACAAAAUGGCA | 738 |
| MTARC1-1981 | 19 mer Anti-sense Strand | UCAAGUUUAGUCAACUUCC | 739 |
| MTARC1-1983 | 19 mer Anti-sense Strand | UUUCAAGUUUAGUCAACUU | 740 |
| MTARC1-1985 | 19 mer Anti-sense Strand | UUUUUCAAGUUUAGUCAAC | 741 |
| MTARC1-1986 | 19 mer Anti-sense Strand | AUUUUUCAAGUUUAGUCAA | 742 |
| MTARC1-1988 | 19 mer Anti-sense Strand | ACAUUUUUCAAGUUUAGUC | 743 |
| MTARC1-1989 | 19 mer Anti-sense Strand | AACAUUUUUCAAGUUUAGU | 744 |
| MTARC1-1990 | 19 mer Anti-sense Strand | AAACAUUUUUCAAGUUUAG | 745 |
| MTARC1-1995 | 19 mer Anti-sense Strand | UUUAAAAACAUUUUUCAAG | 746 |
| MTARC1-1996 | 19 mer Anti-sense Strand | UUUUAAAAACAUUUUUCAA | 747 |
| MTARC1-1998 | 19 mer Anti-sense Strand | AGUUUUAAAAACAUUUUUC | 748 |
| MTARC1-1999 | 19 mer Anti-sense Strand | CAGUUUUAAAAACAUUUUU | 749 |
| MTARC1-2000 | 19 mer Anti-sense Strand | ACAGUUUUAAAAACAUUUU | 750 |
| MTARC1-2001 | 19 mer Anti-sense Strand | CACAGUUUUAAAAACAUUU | 751 |
| MTARC1-2002 | 19 mer Anti-sense Strand | UCACAGUUUUAAAAACAUU | 752 |
| MTARC1-2005 | 19 mer Anti-sense Strand | UAUUCACAGUUUUAAAAAC | 753 |
| MTARC1-2006 | 19 mer Anti-sense Strand | UUAUUCACAGUUUUAAAAA | 754 |
| MTARC1-2010 | 19 mer Anti-sense Strand | CCAUUUAUUCACAGUUUUA | 755 |
| MTARC1-2011 | 19 mer Anti-sense Strand | UCCAUUUAUUCACAGUUUU | 756 |
| MTARC1-2012 | 19 mer Anti-sense Strand | UUCCAUUUAUUCACAGUUU | 757 |
| MTARC1-2013 | 19 mer Anti-sense Strand | CUUCCAUUUAUUCACAGUU | 758 |

-continued

| Name | Strand | Sequence | SEQ ID NO |
|---|---|---|---|
| MTARC1-2015 | 19 mer Anti-sense Strand | AGCUUCCAUUUAUUCACAG | 759 |
| MTARC1-2016 | 19 mer Anti-sense Strand | UAGCUUCCAUUUAUUCACA | 760 |
| MTARC1-2017 | 19 mer Anti-sense Strand | GUAGCUUCCAUUUAUUCAC | 761 |
| MTARC1-2018 | 19 mer Anti-sense Strand | AGUAGCUUCCAUUUAUUCA | 762 |
| MTARC1-2019 | 19 mer Anti-sense Strand | AAGUAGCUUCCAUUUAUUC | 763 |
| MTARC1-2020 | 19 mer Anti-sense Strand | AAAGUAGCUUCCAUUUAUU | 764 |
| MTARC1-2022 | 19 mer Anti-sense Strand | UCAAAGUAGCUUCCAUUUA | 765 |
| MTARC1-2023 | 19 mer Anti-sense Strand | GUCAAAGUAGCUUCCAUUU | 766 |
| MTARC1-2025 | 19 mer Anti-sense Strand | UAGUCAAAGUAGCUUCCAU | 767 |
| MTARC1-2027 | 19 mer Anti-sense Strand | ACUAGUCAAAGUAGCUUCC | 768 |
| MTARC1-231 | 25 mer Sense Strand | GCGCAGCUCUGGAUCUACCAUGUGA | 769 |
| MTARC1-233 | 25 mer Sense Strand | GCAGCUCUGGAUCUACCCUAUGAAA | 770 |
| MTARC1-234 | 25 mer Sense Strand | CAGCUCUGGAUCUACCCUGAGAAAU | 771 |
| MTARC1-235 | 25 mer Sense Strand | AGCUCUGGAUCUACCCUGUAAAAUC | 772 |
| MTARC1-236 | 25 mer Sense Strand | GCUCUGGAUCUACCCUGUGAAAUCC | 773 |
| MTARC1-237 | 25 mer Sense Strand | CUCUGGAUCUACCCUGUGAAAUCCU | 774 |
| MTARC1-238 | 25 mer Sense Strand | UCUGGAUCUACCCUGUGAAAUCCUG | 775 |
| MTARC1-239 | 25 mer Sense Strand | CUGGAUCUACCCUGUGAAAACCUGC | 776 |
| MTARC1-240 | 25 mer Sense Strand | UGGAUCUACCCUGUGAAAUACUGCA | 777 |
| MTARC1-241 | 25 mer Sense Strand | GGAUCUACCCUGUGAAAUCAUGCAA | 778 |
| MTARC1-242 | 25 mer Sense Strand | GAUCUACCCUGUGAAAUCCAGCAAG | 779 |
| MTARC1-243 | 25 mer Sense Strand | AUCUACCCUGUGAAAUCCUACAAGG | 780 |
| MTARC1-244 | 25 mer Sense Strand | UCUACCCUGUGAAAUCCUGAAAGGG | 781 |
| MTARC1-245 | 25 mer Sense Strand | CUACCCUGUGAAAUCCUGCAAGGGG | 782 |
| MTARC1-247 | 25 mer Sense Strand | ACCCUGUGAAAUCCUGCAAGGGGU | 783 |
| MTARC1-248 | 25 mer Sense Strand | CCCUGUGAAAUCCUGCAAGAGGGUG | 784 |
| MTARC1-249 | 25 mer Sense Strand | CCUGUGAAAUCCUGCAAGGAGGUGC | 785 |
| MTARC1-253 | 25 mer Sense Strand | UGAAAUCCUGCAAGGGGUACCGGU | 786 |
| MTARC1-255 | 25 mer Sense Strand | AAAUCCUGCAAGGGGUGCAGGUGA | 787 |
| MTARC1-318 | 25 mer Sense Strand | AACCUGCGGACAGGUUUUAGCUUG | 788 |
| MTARC1-319 | 25 mer Sense Strand | ACCUGCGGACAGGUUUUGACUUGU | 789 |
| MTARC1-320 | 25 mer Sense Strand | CCUGCGGACAGGUUUUGGAUUGUG | 790 |
| MTARC1-321 | 25 mer Sense Strand | CUGCGGACAGGUUUUGGCAUGUGA | 791 |
| MTARC1-323 | 25 mer Sense Strand | GCGGGACAGGUUUUGGCUUAUGAUC | 792 |
| MTARC1-324 | 25 mer Sense Strand | CGGGACAGGUUUUGGCUUGAGAUCA | 793 |
| MTARC1-325 | 25 mer Sense Strand | GGGACAGGUUUUGGCUUGUAAUCAA | 794 |
| MTARC1-326 | 25 mer Sense Strand | GGACAGGUUUUGGCUUGUGAUCAAC | 795 |

SEQUENCE LISTING

| Name | Strand | Sequence | SEQ ID NO |
|---|---|---|---|
| MTARC1-327 | 25 mer Sense Strand | GACAGGUUUUGGCUUGUGAACAACC | 796 |
| MTARC1-328 | 25 mer Sense Strand | ACAGGUUUUGGCUUGUGAUAAACCA | 797 |
| MTARC1-329 | 25 mer Sense Strand | CAGGUUUUGGCUUGUGAUCAACCAG | 798 |
| MTARC1-330 | 25 mer Sense Strand | AGGUUUUGGCUUGUGAUCAACCAGG | 799 |
| MTARC1-331 | 25 mer Sense Strand | GGUUUUGGCUUGUGAUCAAACAGGA | 800 |
| MTARC1-332 | 25 mer Sense Strand | GUUUUGGCUUGUGAUCAACAAGGAG | 801 |
| MTARC1-334 | 25 mer Sense Strand | UUUGGCUUGUGAUCAACCAAGAGGG | 802 |
| MTARC1-335 | 25 mer Sense Strand | UUGGCUUGUGAUCAACCAGAAGGGA | 803 |
| MTARC1-337 | 25 mer Sense Strand | GGCUUGUGAUCAACCAGGAAGGAAA | 804 |
| MTARC1-338 | 25 mer Sense Strand | GCUUGUGAUCAACCAGGAGAGAAAC | 805 |
| MTARC1-339 | 25 mer Sense Strand | CUUGUGAUCAACCAGGAGGAAAACA | 806 |
| MTARC1-340 | 25 mer Sense Strand | UUGUGAUCAACCAGGAGGGAAACAU | 807 |
| MTARC1-341 | 25 mer Sense Strand | UGUGAUCAACCAGGAGGGAAACAUG | 808 |
| MTARC1-342 | 25 mer Sense Strand | GUGAUCAACCAGGAGGGAAACAUGG | 809 |
| MTARC1-343 | 25 mer Sense Strand | UGAUCAACCAGGAGGGAAAAAUGGU | 810 |
| MTARC1-345 | 25 mer Sense Strand | AUCAACCAGGAGGGAAACAAGGUUA | 811 |
| MTARC1-346 | 25 mer Sense Strand | UCAACCAGGAGGGAAACAUAGUUAC | 812 |
| MTARC1-347 | 25 mer Sense Strand | CAACCAGGAGGGAAACAUGAUUACU | 813 |
| MTARC1-348 | 25 mer Sense Strand | AACCAGGAGGGAAACAUGGAUACUG | 814 |
| MTARC1-349 | 25 mer Sense Strand | ACCAGGAGGGAAACAUGGUAACUGC | 815 |
| MTARC1-350 | 25 mer Sense Strand | CCAGGAGGGAAACAUGGUUACUGCU | 816 |
| MTARC1-351 | 25 mer Sense Strand | CAGGAGGGAAACAUGGUUAAUGCUC | 817 |
| MTARC1-352 | 25 mer Sense Strand | AGGAGGGAAACAUGGUUACAGCUCG | 818 |
| MTARC1-353 | 25 mer Sense Strand | GGAGGGAAACAUGGUUACUACUCGC | 819 |
| MTARC1-354 | 25 mer Sense Strand | GAGGGAAACAUGGUUACUGAUCGCC | 820 |
| MTARC1-356 | 25 mer Sense Strand | GGGAAACAUGGUUACUGCUAGCCAG | 821 |
| MTARC1-357 | 25 mer Sense Strand | GGAAACAUGGUUACUGCUCACCAGG | 822 |
| MTARC1-358 | 25 mer Sense Strand | GAAACAUGGUUACUGCUCGACAGGA | 823 |
| MTARC1-359 | 25 mer Sense Strand | AAACAUGGUUACUGCUCGCAAGGAA | 824 |
| MTARC1-360 | 25 mer Sense Strand | AACAUGGUUACUGCUCGCCAGGAAC | 825 |
| MTARC1-361 | 25 mer Sense Strand | ACAUGGUUACUGCUCGCCAAGAACC | 826 |
| MTARC1-362 | 25 mer Sense Strand | CAUGGUUACUGCUCGCCAGAAACCU | 827 |
| MTARC1-365 | 25 mer Sense Strand | GGUUACUGCUCGCCAGGAAACUCGC | 828 |
| MTARC1-376 | 25 mer Sense Strand | GCCAGGAACCUCGCCUGGUACUGAU | 829 |
| MTARC1-379 | 25 mer Sense Strand | AGGAACCUCGCCUGGUCCUAAUUUC | 830 |
| MTARC1-384 | 25 mer Sense Strand | CCUCGCCUGGUCCUGAUUUACCUGA | 831 |

SEQUENCE LISTING

| Name | Strand | Sequence | SEQ ID NO |
|---|---|---|---|
| MTARC1-385 | 25 mer Sense Strand | CUCGCCUGGUCCUGAUUUCACUGAC | 832 |
| MTARC1-388 | 25 mer Sense Strand | GCCUGGUCCUGAUUUCCCUAACCUG | 833 |
| MTARC1-390 | 25 mer Sense Strand | CUGGUCCUGAUUUCCCUGAACUGCG | 834 |
| MTARC1-391 | 25 mer Sense Strand | UGGUCCUGAUUUCCCUGACAUGCGA | 835 |
| MTARC1-393 | 25 mer Sense Strand | GUCCUGAUUUCCCUGACCUACGAUG | 836 |
| MTARC1-395 | 25 mer Sense Strand | CCUGAUUUCCCUGACCUGCAAUGGU | 837 |
| MTARC1-405 | 25 mer Sense Strand | CUGACCUGCGAUGGUGACAACCUGA | 838 |
| MTARC1-409 | 25 mer Sense Strand | CCUGCGAUGGUGACACCCUAACUCU | 839 |
| MTARC1-411 | 25 mer Sense Strand | UGCGAUGGUGACACCCUGAAUCUCA | 840 |
| MTARC1-412 | 25 mer Sense Strand | GCGAUGGUGACACCCUGACACUCAG | 841 |
| MTARC1-413 | 25 mer Sense Strand | CGAUGGUGACACCCUGACUAUCAGU | 842 |
| MTARC1-414 | 25 mer Sense Strand | GAUGGUGACACCCUGACUCACAGUG | 843 |
| MTARC1-415 | 25 mer Sense Strand | AUGGUGACACCCUGACUCUAAGUGC | 844 |
| MTARC1-416 | 25 mer Sense Strand | UGGUGACACCCUGACUCUCAGUGCA | 845 |
| MTARC1-417 | 25 mer Sense Strand | GGUGACACCCUGACUCUCAAUGCAG | 846 |
| MTARC1-418 | 25 mer Sense Strand | GUGACACCCUGACUCUCAGAGCAGC | 847 |
| MTARC1-419 | 25 mer Sense Strand | UGACACCCUGACUCUCAGUACAGCC | 848 |
| MTARC1-420 | 25 mer Sense Strand | GACACCCUGACUCUCAGUGAAGCCU | 849 |
| MTARC1-421 | 25 mer Sense Strand | ACACCCUGACUCUCAGUGCAGCCUA | 850 |
| MTARC1-422 | 25 mer Sense Strand | CACCCUGACUCUCAGUGCAACCUAC | 851 |
| MTARC1-423 | 25 mer Sense Strand | ACCCUGACUCUCAGUGCAGACUACA | 852 |
| MTARC1-424 | 25 mer Sense Strand | CCCUGACUCUCAGUGCAGCAUACAC | 853 |
| MTARC1-425 | 25 mer Sense Strand | CCUGACUCUCAGUGCAGCCAACACA | 854 |
| MTARC1-426 | 25 mer Sense Strand | CUGACUCUCAGUGCAGCCUACACAA | 855 |
| MTARC1-427 | 25 mer Sense Strand | UGACUCUCAGUGCAGCCUAAACAAA | 856 |
| MTARC1-428 | 25 mer Sense Strand | GACUCUCAGUGCAGCCUACACAAAG | 857 |
| MTARC1-429 | 25 mer Sense Strand | ACUCUCAGUGCAGCCUACAAAAAGG | 858 |
| MTARC1-430 | 25 mer Sense Strand | CUCUCAGUGCAGCCUACACAAAGGA | 859 |
| MTARC1-431 | 25 mer Sense Strand | UCUCAGUGCAGCCUACACAAAGGAC | 860 |
| MTARC1-433 | 25 mer Sense Strand | UCAGUGCAGCCUACACAAAAGACCU | 861 |
| MTARC1-434 | 25 mer Sense Strand | CAGUGCAGCCUACACAAAGAACCUA | 862 |
| MTARC1-435 | 25 mer Sense Strand | AGUGCAGCCUACACAAAGGACCUAC | 863 |
| MTARC1-436 | 25 mer Sense Strand | GUGCAGCCUACACAAAGGAACUACU | 864 |
| MTARC1-437 | 25 mer Sense Strand | UGCAGCCUACACAAAGGACAUACUA | 865 |
| MTARC1-438 | 25 mer Sense Strand | GCAGCCUACACAAAGGACCAACUAC | 866 |
| MTARC1-439 | 25 mer Sense Strand | CAGCCUACACAAAGGACCUACUACU | 867 |
| MTARC1-440 | 25 mer Sense Strand | AGCCUACACAAAGGACCUAAUACUG | 868 |

SEQUENCE LISTING

| Name | Strand | Sequence | SEQ ID NO |
|---|---|---|---|
| MTARC1-441 | 25 mer Sense Strand | GCCUACACAAAGGACCUACAACUGC | 869 |
| MTARC1-445 | 25 mer Sense Strand | ACACAAAGGACCUACUACUACCUAU | 870 |
| MTARC1-446 | 25 mer Sense Strand | CACAAAGGACCUACUACUGACUAUC | 871 |
| MTARC1-447 | 25 mer Sense Strand | ACAAAGGACCUACUACUGCAUAUCA | 872 |
| MTARC1-448 | 25 mer Sense Strand | CAAAGGACCUACUACUGCCAAUCAA | 873 |
| MTARC1-449 | 25 mer Sense Strand | AAAGGACCUACUACUGCCUAUCAAA | 874 |
| MTARC1-450 | 25 mer Sense Strand | AAGGACCUACUACUGCCUAACAAAA | 875 |
| MTARC1-451 | 25 mer Sense Strand | AGGACCUACUACUGCCUAUAAAAAC | 876 |
| MTARC1-452 | 25 mer Sense Strand | GGACCUACUACUGCCUAUCAAAACG | 877 |
| MTARC1-453 | 25 mer Sense Strand | GACCUACUACUGCCUAUCAAAACGC | 878 |
| MTARC1-454 | 25 mer Sense Strand | ACCUACUACUGCCUAUCAAAACGCC | 879 |
| MTARC1-456 | 25 mer Sense Strand | CUACUACUGCCUAUCAAAAGCCCA | 880 |
| MTARC1-457 | 25 mer Sense Strand | UACUACUGCCUAUCAAAACACCCAC | 881 |
| MTARC1-458 | 25 mer Sense Strand | ACUACUGCCUAUCAAAACGACCACC | 882 |
| MTARC1-459 | 25 mer Sense Strand | CUACUGCCUAUCAAAACGCACACCA | 883 |
| MTARC1-460 | 25 mer Sense Strand | UACUGCCUAUCAAAACGCCAACCAC | 884 |
| MTARC1-462 | 25 mer Sense Strand | CUGCCUAUCAAAACGCCCAACACAA | 885 |
| MTARC1-468 | 25 mer Sense Strand | AUCAAAACGCCCACCACAAAUGCAG | 886 |
| MTARC1-469 | 25 mer Sense Strand | UCAAAACGCCCACCACAAAAGCAGU | 887 |
| MTARC1-470 | 25 mer Sense Strand | CAAAACGCCCACCACAAAUACAGUG | 888 |
| MTARC1-471 | 25 mer Sense Strand | AAAACGCCCACCACAAAUGAAGUGC | 889 |
| MTARC1-473 | 25 mer Sense Strand | AACGCCCACCACAAAUGCAAUGCAC | 890 |
| MTARC1-475 | 25 mer Sense Strand | CGCCCACCACAAAUGCAGUACACAA | 891 |
| MTARC1-476 | 25 mer Sense Strand | GCCCACCACAAAUGCAGUGAACAAG | 892 |
| MTARC1-482 | 25 mer Sense Strand | CACAAAUGCAGUGCACAAGAGCAGA | 893 |
| MTARC1-483 | 25 mer Sense Strand | ACAAAUGCAGUGCACAAGUACAGAG | 894 |
| MTARC1-484 | 25 mer Sense Strand | CAAAUGCAGUGCACAAGUGAAGAGU | 895 |
| MTARC1-552 | 25 mer Sense Strand | GCCCAGUGGAUAACCAGCUACCUGA | 896 |
| MTARC1-553 | 25 mer Sense Strand | CCCAGUGGAUAACCAGCUUACUGAA | 897 |
| MTARC1-554 | 25 mer Sense Strand | CCAGUGGAUAACCAGCUUCAUGAAG | 898 |
| MTARC1-555 | 25 mer Sense Strand | CAGUGGAUAACCAGCUUCCAGAAGU | 899 |
| MTARC1-556 | 25 mer Sense Strand | AGUGGAUAACCAGCUUCCUAAAGUC | 900 |
| MTARC1-557 | 25 mer Sense Strand | GUGGAUAACCAGCUUCCUGAAGUCA | 901 |
| MTARC1-558 | 25 mer Sense Strand | UGGAUAACCAGCUUCCUGAAGUCAC | 902 |
| MTARC1-559 | 25 mer Sense Strand | GGAUAACCAGCUUCCUGAAAUCACA | 903 |
| MTARC1-560 | 25 mer Sense Strand | GAUAACCAGCUUCCUGAAGACACAG | 904 |

-continued

SEQUENCE LISTING

| Name | Strand | Sequence | SEQ ID NO |
|---|---|---|---|
| MTARC1-561 | 25 mer Sense Strand | AUAACCAGCUUCCUGAAGUAACAGC | 905 |
| MTARC1-562 | 25 mer Sense Strand | UAACCAGCUUCCUGAAGUCACAGCC | 906 |
| MTARC1-563 | 25 mer Sense Strand | AACCAGCUUCCUGAAGUCAAAGCCC | 907 |
| MTARC1-564 | 25 mer Sense Strand | ACCAGCUUCCUGAAGUCACAGCCCU | 908 |
| MTARC1-565 | 25 mer Sense Strand | CCAGCUUCCUGAAGUCACAACCCUA | 909 |
| MTARC1-566 | 25 mer Sense Strand | CAGCUUCCUGAAGUCACAGACCUAC | 910 |
| MTARC1-567 | 25 mer Sense Strand | AGCUUCCUGAAGUCACAGCACUACC | 911 |
| MTARC1-568 | 25 mer Sense Strand | GCUUCCUGAAGUCACAGCCAUACCG | 912 |
| MTARC1-589 | 25 mer Sense Strand | ACCGCCUGGUGCACUUCGAACCUCA | 913 |
| MTARC1-591 | 25 mer Sense Strand | CGCCUGGUGCACUUCGAGCAUCACA | 914 |
| MTARC1-592 | 25 mer Sense Strand | GCCUGGUGCACUUCGAGCCACACAU | 915 |
| MTARC1-593 | 25 mer Sense Strand | CCUGGUGCACUUCGAGCCUAACAUG | 916 |
| MTARC1-597 | 25 mer Sense Strand | GUGCACUUCGAGCCUCACAAGCGAC | 917 |
| MTARC1-600 | 25 mer Sense Strand | CACUUCGAGCCUCACAUGCAACCGA | 918 |
| MTARC1-612 | 25 mer Sense Strand | CACAUGCGACCGAGACGUCAUCAUC | 919 |
| MTARC1-614 | 25 mer Sense Strand | CAUGCGACCGAGACGUCCUAAUCAA | 920 |
| MTARC1-617 | 25 mer Sense Strand | GCGACCGAGACGUCCUCAUAAAAUA | 921 |
| MTARC1-618 | 25 mer Sense Strand | CGACCGAGACGUCCUCAUCAAAUAG | 922 |
| MTARC1-620 | 25 mer Sense Strand | ACCGAGACGUCCUCAUCAAAUAGCA | 923 |
| MTARC1-621 | 25 mer Sense Strand | CCGAGACGUCCUCAUCAAAAGCAG | 924 |
| MTARC1-622 | 25 mer Sense Strand | CGAGACGUCCUCAUCAAAUAGCAGA | 925 |
| MTARC1-623 | 25 mer Sense Strand | GAGACGUCCUCAUCAAAUAACAGAC | 926 |
| MTARC1-624 | 25 mer Sense Strand | AGACGUCCUCAUCAAAUAGAAGACU | 927 |
| MTARC1-625 | 25 mer Sense Strand | GACGUCCUCAUCAAAUAGCAGACUU | 928 |
| MTARC1-626 | 25 mer Sense Strand | ACGUCCUCAUCAAAUAGCAAACUUG | 929 |
| MTARC1-627 | 25 mer Sense Strand | CGUCCUCAUCAAAUAGCAGACUUGU | 930 |
| MTARC1-628 | 25 mer Sense Strand | GUCCUCAUCAAAUAGCAGAAUUGUU | 931 |
| MTARC1-629 | 25 mer Sense Strand | UCCUCAUCAAAUAGCAGACAUGUUC | 932 |
| MTARC1-630 | 25 mer Sense Strand | CCUCAUCAAAUAGCAGACUAGUUCC | 933 |
| MTARC1-631 | 25 mer Sense Strand | CUCAUCAAAUAGCAGACUUAUUCCG | 934 |
| MTARC1-632 | 25 mer Sense Strand | UCAUCAAAUAGCAGACUUGAUCCGA | 935 |
| MTARC1-633 | 25 mer Sense Strand | CAUCAAAUAGCAGACUUGUACCGAC | 936 |
| MTARC1-634 | 25 mer Sense Strand | AUCAAAUAGCAGACUUGUUACGACC | 937 |
| MTARC1-635 | 25 mer Sense Strand | UCAAAUAGCAGACUUGUUCAGACCC | 938 |
| MTARC1-636 | 25 mer Sense Strand | CAAAUAGCAGACUUGUUCCAACCCA | 939 |
| MTARC1-637 | 25 mer Sense Strand | AAAUAGCAGACUUGUUCCGACCCAA | 940 |
| MTARC1-638 | 25 mer Sense Strand | AAUAGCAGACUUGUUCCGAACCAAG | 941 |

-continued

SEQUENCE LISTING

| Name | Strand | Sequence | SEQ ID NO |
|---|---|---|---|
| MTARC1-639 | 25 mer Sense Strand | AUAGCAGACUUGUUCCGACACAAGG | 942 |
| MTARC1-640 | 25 mer Sense Strand | UAGCAGACUUGUUCCGACCAAAGGA | 943 |
| MTARC1-641 | 25 mer Sense Strand | AGCAGACUUGUUCCGACCCAAGGAC | 944 |
| MTARC1-642 | 25 mer Sense Strand | GCAGACUUGUUCCGACCCAAGGACC | 945 |
| MTARC1-643 | 25 mer Sense Strand | CAGACUUGUUCCGACCCAAAGACCA | 946 |
| MTARC1-644 | 25 mer Sense Strand | AGACUUGUUCCGACCCAAGAACCAG | 947 |
| MTARC1-645 | 25 mer Sense Strand | GACUUGUUCCGACCCAAGGACCAGA | 948 |
| MTARC1-646 | 25 mer Sense Strand | ACUUGUUCCGACCCAAGGAACAGAU | 949 |
| MTARC1-647 | 25 mer Sense Strand | CUUGUUCCGACCCAAGGACAAGAUU | 950 |
| MTARC1-648 | 25 mer Sense Strand | UUGUUCCGACCCAAGGACCAGAUUG | 951 |
| MTARC1-649 | 25 mer Sense Strand | UGUUCCGACCCAAGGACCAAAUUGC | 952 |
| MTARC1-650 | 25 mer Sense Strand | GUUCCGACCCAAGGACCAGAUUGCU | 953 |
| MTARC1-651 | 25 mer Sense Strand | UUCCGACCCAAGGACCAGAAUGCUU | 954 |
| MTARC1-652 | 25 mer Sense Strand | UCCGACCCAAGGACCAGAUAGCUUA | 955 |
| MTARC1-653 | 25 mer Sense Strand | CCGACCCAAGGACCAGAUUACUUAC | 956 |
| MTARC1-654 | 25 mer Sense Strand | CGACCCAAGGACCAGAUUGAUUACU | 957 |
| MTARC1-655 | 25 mer Sense Strand | GACCCAAGGACCAGAUUGCAUACUC | 958 |
| MTARC1-656 | 25 mer Sense Strand | ACCCAAGGACCAGAUUGCUAACUCA | 959 |
| MTARC1-657 | 25 mer Sense Strand | CCCAAGGACCAGAUUGCUUACUCAG | 960 |
| MTARC1-658 | 25 mer Sense Strand | CCAAGGACCAGAUUGCUUAAUCAGA | 961 |
| MTARC1-659 | 25 mer Sense Strand | CAAGGACCAGAUUGCUUACACAGAC | 962 |
| MTARC1-660 | 25 mer Sense Strand | AAGGACCAGAUUGCUUACUAAGACA | 963 |
| MTARC1-661 | 25 mer Sense Strand | AGGACCAGAUUGCUUACUCAGACAC | 964 |
| MTARC1-662 | 25 mer Sense Strand | GGACCAGAUUGCUUACUCAAACACC | 965 |
| MTARC1-663 | 25 mer Sense Strand | GACCAGAUUGCUUACUCAGACACCA | 966 |
| MTARC1-664 | 25 mer Sense Strand | ACCAGAUUGCUUACUCAGAAACCAG | 967 |
| MTARC1-665 | 25 mer Sense Strand | CCAGAUUGCUUACUCAGACACCAGC | 968 |
| MTARC1-666 | 25 mer Sense Strand | CAGAUUGCUUACUCAGACAACAGCC | 969 |
| MTARC1-667 | 25 mer Sense Strand | AGAUUGCUUACUCAGACACAAGCCC | 970 |
| MTARC1-668 | 25 mer Sense Strand | GAUUGCUUACUCAGACACCAGCCCA | 971 |
| MTARC1-669 | 25 mer Sense Strand | AUUGCUUACUCAGACACCAACCCAU | 972 |
| MTARC1-670 | 25 mer Sense Strand | UUGCUUACUCAGACACCAGACCAUU | 973 |
| MTARC1-671 | 25 mer Sense Strand | UGCUUACUCAGACACCAGCACAUUC | 974 |
| MTARC1-672 | 25 mer Sense Strand | GCUUACUCAGACACCAGCCAAUUCU | 975 |
| MTARC1-673 | 25 mer Sense Strand | CUUACUCAGACACCAGCCCAUUCUU | 976 |
| MTARC1-674 | 25 mer Sense Strand | UUACUCAGACACCAGCCCAAUCUUG | 977 |

SEQUENCE LISTING

| Name | Strand | Sequence | SEQ ID NO |
|---|---|---|---|
| MTARC1-675 | 25 mer Sense Strand | UACUCAGACACCAGCCCAUACUUGA | 978 |
| MTARC1-676 | 25 mer Sense Strand | ACUCAGACACCAGCCCAUUAUUGAU | 979 |
| MTARC1-677 | 25 mer Sense Strand | CUCAGACACCAGCCCAUUCAUGAUC | 980 |
| MTARC1-678 | 25 mer Sense Strand | UCAGACACCAGCCCAUUCUAGAUCC | 981 |
| MTARC1-679 | 25 mer Sense Strand | CAGACACCAGCCCAUUCUUAAUCCU | 982 |
| MTARC1-680 | 25 mer Sense Strand | AGACACCAGCCCAUUCUUGAUCCUU | 983 |
| MTARC1-681 | 25 mer Sense Strand | GACACCAGCCCAUUCUUGAACCUUU | 984 |
| MTARC1-682 | 25 mer Sense Strand | ACACCAGCCCAUUCUUGAUACUUUC | 985 |
| MTARC1-683 | 25 mer Sense Strand | CACCAGCCCAUUCUUGAUCAUUUCU | 986 |
| MTARC1-684 | 25 mer Sense Strand | ACCAGCCCAUUCUUGAUCCAUUCUG | 987 |
| MTARC1-685 | 25 mer Sense Strand | CCAGCCCAUUCUUGAUCCUAUCUGA | 988 |
| MTARC1-686 | 25 mer Sense Strand | CAGCCCAUUCUUGAUCCUUACUGAG | 989 |
| MTARC1-687 | 25 mer Sense Strand | AGCCCAUUCUUGAUCCUUUAUGAGG | 990 |
| MTARC1-691 | 25 mer Sense Strand | CAUUCUUGAUCCUUUCUGAAGCGUC | 991 |
| MTARC1-692 | 25 mer Sense Strand | AUUCUUGAUCCUUUCUGAGACGUCG | 992 |
| MTARC1-724 | 25 mer Sense Strand | AUCUCAACUCCAGGCUAGAAAAGAA | 993 |
| MTARC1-726 | 25 mer Sense Strand | CUCAACUCCAGGCUAGAGAAGAAAG | 994 |
| MTARC1-728 | 25 mer Sense Strand | CAACUCCAGGCUAGAGAAGAAAGUU | 995 |
| MTARC1-729 | 25 mer Sense Strand | AACUCCAGGCUAGAGAAGAAAGUUA | 996 |
| MTARC1-730 | 25 mer Sense Strand | ACUCCAGGCUAGAGAAGAAAGUUAA | 997 |
| MTARC1-731 | 25 mer Sense Strand | CUCCAGGCUAGAGAAGAAAAUUAAA | 998 |
| MTARC1-733 | 25 mer Sense Strand | CCAGGCUAGAGAAGAAAGUAAAAGC | 999 |
| MTARC1-734 | 25 mer Sense Strand | CAGGCUAGAGAAGAAAGUUAAAGCA | 1000 |
| MTARC1-735 | 25 mer Sense Strand | AGGCUAGAGAAGAAAGUUAAAGCAA | 1001 |
| MTARC1-736 | 25 mer Sense Strand | GGCUAGAGAAGAAAGUUAAAGCAAC | 1002 |
| MTARC1-737 | 25 mer Sense Strand | GCUAGAGAAGAAAGUUAAAACAACC | 1003 |
| MTARC1-738 | 25 mer Sense Strand | CUAGAGAAGAAAGUUAAAGAAACCA | 1004 |
| MTARC1-739 | 25 mer Sense Strand | UAGAGAAGAAAGUUAAAGCAACCAA | 1005 |
| MTARC1-740 | 25 mer Sense Strand | AGAGAAGAAAGUUAAAGCAACCAAC | 1006 |
| MTARC1-741 | 25 mer Sense Strand | GAGAAGAAAGUUAAAGCAAACAACU | 1007 |
| MTARC1-742 | 25 mer Sense Strand | AGAAGAAAGUUAAAGCAACAAACUU | 1008 |
| MTARC1-743 | 25 mer Sense Strand | GAAGAAAGUUAAAGCAACCAACUUC | 1009 |
| MTARC1-744 | 25 mer Sense Strand | AAGAAAGUUAAAGCAACCAACUUCA | 1010 |
| MTARC1-745 | 25 mer Sense Strand | AGAAAGUUAAAGCAACCAAUUCAG | 1011 |
| MTARC1-746 | 25 mer Sense Strand | GAAAGUUAAAGCAACCAACAUCAGG | 1012 |
| MTARC1-747 | 25 mer Sense Strand | AAAGUUAAAGCAACCAACUACAGGC | 1013 |
| MTARC1-748 | 25 mer Sense Strand | AAGUUAAAGCAACCAACUUAAGGCC | 1014 |

-continued

| Name | Strand | Sequence | SEQ ID NO |
|---|---|---|---|
| MTARC1-750 | 25 mer Sense Strand | GUUAAAGCAACCAACUUCAAGCCCA | 1015 |
| MTARC1-751 | 25 mer Sense Strand | UUAAAGCAACCAACUUCAGACCCAA | 1016 |
| MTARC1-752 | 25 mer Sense Strand | UAAAGCAACCAACUUCAGGACCAAU | 1017 |
| MTARC1-753 | 25 mer Sense Strand | AAAGCAACCAACUUCAGGCACAAUA | 1018 |
| MTARC1-754 | 25 mer Sense Strand | AAGCAACCAACUUCAGGCCAAAUAU | 1019 |
| MTARC1-755 | 25 mer Sense Strand | AGCAACCAACUUCAGGCCCAAUAUU | 1020 |
| MTARC1-756 | 25 mer Sense Strand | GCAACCAACUUCAGGCCCAAUAUUG | 1021 |
| MTARC1-758 | 25 mer Sense Strand | AACCAACUUCAGGCCCAAUAUUGUA | 1022 |
| MTARC1-759 | 25 mer Sense Strand | ACCAACUUCAGGCCCAAUAAUGUAA | 1023 |
| MTARC1-760 | 25 mer Sense Strand | CCAACUUCAGGCCCAAUAUAGUAAU | 1024 |
| MTARC1-761 | 25 mer Sense Strand | CAACUUCAGGCCCAAUAUUAUAAUU | 1025 |
| MTARC1-762 | 25 mer Sense Strand | AACUUCAGGCCCAAUAUUGAAAUUU | 1026 |
| MTARC1-763 | 25 mer Sense Strand | ACUUCAGGCCCAAUAUUGUAAUUUC | 1027 |
| MTARC1-764 | 25 mer Sense Strand | CUUCAGGCCCAAUAUUGUAAUUUCA | 1028 |
| MTARC1-765 | 25 mer Sense Strand | UUCAGGCCCAAUAUUGUAAAUUCAG | 1029 |
| MTARC1-766 | 25 mer Sense Strand | UCAGGCCCAAUAUUGUAAUAUCAGG | 1030 |
| MTARC1-767 | 25 mer Sense Strand | CAGGCCCAAUAUUGUAAUUACAGGA | 1031 |
| MTARC1-768 | 25 mer Sense Strand | AGGCCCAAUAUUGUAAUUUAAGGAU | 1032 |
| MTARC1-769 | 25 mer Sense Strand | GGCCCAAUAUUGUAAUUUCAGGAUG | 1033 |
| MTARC1-770 | 25 mer Sense Strand | GCCCAAUAUUGUAAUUUCAAGAUGC | 1034 |
| MTARC1-771 | 25 mer Sense Strand | CCCAAUAUUGUAAUUUCAGAAUGCG | 1035 |
| MTARC1-772 | 25 mer Sense Strand | CCAAUAUUGUAAUUUCAGGAUGCGA | 1036 |
| MTARC1-773 | 25 mer Sense Strand | CAAUAUUGUAAUUUCAGGAAGCGAU | 1037 |
| MTARC1-774 | 25 mer Sense Strand | AAUAUUGUAAUUUCAGGAUACGAUG | 1038 |
| MTARC1-775 | 25 mer Sense Strand | AUAUUGUAAUUUCAGGAUGAGAUGU | 1039 |
| MTARC1-776 | 25 mer Sense Strand | UAUUGUAAUUUCAGGAUGCAAUGUC | 1040 |
| MTARC1-777 | 25 mer Sense Strand | AUUGUAAUUUCAGGAUGCGAUGUCU | 1041 |
| MTARC1-778 | 25 mer Sense Strand | UUGUAAUUUCAGGAUGCGAAGUCUA | 1042 |
| MTARC1-779 | 25 mer Sense Strand | UGUAAUUUCAGGAUGCGAUAUCUAU | 1043 |
| MTARC1-780 | 25 mer Sense Strand | GUAAUUUCAGGAUGCGAUGACUAUG | 1044 |
| MTARC1-781 | 25 mer Sense Strand | UAAUUUCAGGAUGCGAUGUAUAUGC | 1045 |
| MTARC1-782 | 25 mer Sense Strand | AAUUUCAGGAUGCGAUGUCAAUGCA | 1046 |
| MTARC1-783 | 25 mer Sense Strand | AUUUCAGGAUGCGAUGUCUAUGCAG | 1047 |
| MTARC1-784 | 25 mer Sense Strand | UUUCAGGAUGCGAUGUCUAAGCAGA | 1048 |
| MTARC1-785 | 25 mer Sense Strand | UUCAGGAUGCGAUGUCUAUACGAGAG | 1049 |
| MTARC1-786 | 25 mer Sense Strand | UCAGGAUGCGAUGUCUAUGAAGAGG | 1050 |

-continued

| Name | Strand | Sequence | SEQ ID NO |
|---|---|---|---|
| MTARC1-787 | 25 mer Sense Strand | CAGGAUGCGAUGUCUAUGCAGAGGA | 1051 |
| MTARC1-788 | 25 mer Sense Strand | AGGAUGCGAUGUCUAUGCAAAGGAU | 1052 |
| MTARC1-789 | 25 mer Sense Strand | GGAUGCGAUGUCUAUGCAGAGGAUU | 1053 |
| MTARC1-790 | 25 mer Sense Strand | GAUGCGAUGUCUAUGCAGAAGAUUC | 1054 |
| MTARC1-791 | 25 mer Sense Strand | AUGCGAUGUCUAUGCAGAGAAUUCU | 1055 |
| MTARC1-792 | 25 mer Sense Strand | UGCGAUGUCUAUGCAGAGGAAACAC | 1056 |
| MTARC1-863 | 25 mer Sense Strand | UUGUUCCAGAUGCAUUUUAACCACA | 1057 |
| MTARC1-929 | 25 mer Sense Strand | GGAAACACUGAAGAGUUAUAGCCAG | 1058 |
| MTARC1-930 | 25 mer Sense Strand | GAAACACUGAAGAGUUAUCACCAGU | 1059 |
| MTARC1-934 | 25 mer Sense Strand | CACUGAAGAGUUAUCGCCAAUGUGA | 1060 |
| MTARC1-955 | 25 mer Sense Strand | GUGACCCUUCAGAACGAAAAUUAUA | 1061 |
| MTARC1-959 | 25 mer Sense Strand | CCCUUCAGAACGAAAGUUAAAUGGA | 1062 |
| MTARC1-960 | 25 mer Sense Strand | CCUUCAGAACGAAAGUUAUAUGGAA | 1063 |
| MTARC1-963 | 25 mer Sense Strand | UCAGAACGAAAGUUAUAUGAAAAAU | 1064 |
| MTARC1-964 | 25 mer Sense Strand | CAGAACGAAAGUUAUAUGGAAAAUC | 1065 |
| MTARC1-965 | 25 mer Sense Strand | AGAACGAAAGUUAUAUGGAAAAUCA | 1066 |
| MTARC1-966 | 25 mer Sense Strand | GAACGAAAGUUAUAUGGAAAAUCAC | 1067 |
| MTARC1-967 | 25 mer Sense Strand | AACGAAAGUUAUAUGGAAAAUCACC | 1068 |
| MTARC1-969 | 25 mer Sense Strand | CGAAAGUUAUAUGGAAAAUAACCAC | 1069 |
| MTARC1-970 | 25 mer Sense Strand | GAAAGUUAUAUGGAAAAUCACCACU | 1070 |
| MTARC1-971 | 25 mer Sense Strand | AAAGUUAUAUGGAAAAUCAACACUC | 1071 |
| MTARC1-1107 | 25 mer Sense Strand | AAAAAUGUUCUCAAAAAUGACAACA | 1072 |
| MTARC1-1113 | 25 mer Sense Strand | GUUCUCAAAAAUGACAACAAUUGAA | 1073 |
| MTARC1-1118 | 25 mer Sense Strand | CAAAAAUGACAACACUUGAAGCAUG | 1074 |
| MTARC1-1123 | 25 mer Sense Strand | AUGACAACACUUGAAGCAUAGUGUU | 1075 |
| MTARC1-1126 | 25 mer Sense Strand | ACAACACUUGAAGCAUGGUAUUUCA | 1076 |
| MTARC1-1127 | 25 mer Sense Strand | CAACACUUGAAGCAUGGUGAUUCAG | 1077 |
| MTARC1-1128 | 25 mer Sense Strand | AACACUUGAAGCAUGGUGUAUCAGA | 1078 |
| MTARC1-1129 | 25 mer Sense Strand | ACACUUGAAGCAUGGUGUUACAGAA | 1079 |
| MTARC1-1130 | 25 mer Sense Strand | CACUUGAAGCAUGGUGUUUAAGAAC | 1080 |
| MTARC1-1132 | 25 mer Sense Strand | CUUGAAGCAUGGUGUUUCAAAACUG | 1081 |
| MTARC1-1133 | 25 mer Sense Strand | UUGAAGCAUGGUGUUUCAGAACUGA | 1082 |
| MTARC1-1134 | 25 mer Sense Strand | UGAAGCAUGGUGUUUCAGAACUGAG | 1083 |
| MTARC1-1135 | 25 mer Sense Strand | GAAGCAUGGUGUUUCAGAAAUGAGA | 1084 |
| MTARC1-1139 | 25 mer Sense Strand | CAUGGUGUUUCAGAACUGAAACCUC | 1085 |
| MTARC1-1144 | 25 mer Sense Strand | UGUUUCAGAACUGAGACCUAUACAU | 1086 |
| MTARC1-1165 | 25 mer Sense Strand | ACAUUUUCUUUAAAUUUGUAAUUUU | 1087 |

-continued

SEQUENCE LISTING

| Name | Strand | Sequence | SEQ ID NO |
|---|---|---|---|
| MTARC1-1167 25 mer | Sense Strand | AUUUUCUUUAAAUUUGUGAAUUUCA | 1088 |
| MTARC1-1173 25 mer | Sense Strand | UUUAAAUUUGUGAUUUUCAAAUUUU | 1089 |
| MTARC1-1177 25 mer | Sense Strand | AAUUUGUGAUUUUCACAUUAUUCGU | 1090 |
| MTARC1-1179 25 mer | Sense Strand | UUUGUGAUUUUCACAUUUUACGUCU | 1091 |
| MTARC1-1329 25 mer | Sense Strand | GUUUAACUGAUUAUGGAAUAGUUCU | 1092 |
| MTARC1-1330 25 mer | Sense Strand | UUUAACUGAUUAUGGAAUAAUUCUU | 1093 |
| MTARC1-1332 25 mer | Sense Strand | UAACUGAUUAUGGAAUAGUACUUUC | 1094 |
| MTARC1-1333 25 mer | Sense Strand | AACUGAUUAUGGAAUAGUUAUUUCU | 1095 |
| MTARC1-1334 25 mer | Sense Strand | ACUGAUUAUGGAAUAGUUCAUUCUC | 1096 |
| MTARC1-1335 25 mer | Sense Strand | CUGAUUAUGGAAUAGUUCUAUCUCC | 1097 |
| MTARC1-1620 25 mer | Sense Strand | CAGAUAUUAAUUUUCCAUAAAUCUG | 1098 |
| MTARC1-1622 25 mer | Sense Strand | GAUAUUAAUUUUCCAUAGAACUGGA | 1099 |
| MTARC1-1660 25 mer | Sense Strand | CUUCUCAGACAGCAUUGGAAUUCCU | 1100 |
| MTARC1-1663 25 mer | Sense Strand | CUCAGACAGCAUUGGAUUUACUAAA | 1101 |
| MTARC1-1664 25 mer | Sense Strand | UCAGACAGCAUUGGAUUUCAUAAAG | 1102 |
| MTARC1-1812 25 mer | Sense Strand | AGAAAGUGAUUCAGUGAUAUCAGA | 1103 |
| MTARC1-1816 25 mer | Sense Strand | AAGUGAUUCAGUGAUUUCAAAUAGA | 1104 |
| MTARC1-1868 25 mer | Sense Strand | GGAAAGCAUAUGUCAGUUGAUUAAA | 1105 |
| MTARC1-1869 25 mer | Sense Strand | GAAAGCAUAUGUCAGUUGUAUAAAA | 1106 |
| MTARC1-1876 25 mer | Sense Strand | UAUGUCAGUUGUUUAAAACACAAUA | 1107 |
| MTARC1-1877 25 mer | Sense Strand | AUGUCAGUUGUUUAAAACCAAAUAU | 1108 |
| MTARC1-1878 25 mer | Sense Strand | UGUCAGUUGUUUAAAACCCAAUAUC | 1109 |
| MTARC1-1879 25 mer | Sense Strand | GUCAGUUGUUUAAAACCCAAUAUCU | 1110 |
| MTARC1-1882 25 mer | Sense Strand | AGUUGUUUAAAACCCAAUAACUAUU | 1111 |
| MTARC1-1883 25 mer | Sense Strand | GUUGUUUAAAACCCAAUAUAUAUUU | 1112 |
| MTARC1-1884 25 mer | Sense Strand | UUGUUUAAAACCCAAUAUCAAUUUU | 1113 |
| MTARC1-1885 25 mer | Sense Strand | UGUUUAAAACCCAAUAUCUAUUUUU | 1114 |
| MTARC1-1886 25 mer | Sense Strand | GUUUAAAACCCAAUAUCUAAUUUUU | 1115 |
| MTARC1-1935 25 mer | Sense Strand | UGAUGAAGUAUAUUUUUUAAUGCCA | 1116 |
| MTARC1-1936 25 mer | Sense Strand | GAUGAAGUAUAUUUUUUAUAGCCAU | 1117 |
| MTARC1-1937 25 mer | Sense Strand | AUGAAGUAUAUUUUUUAUUACCAUU | 1118 |
| MTARC1-1939 25 mer | Sense Strand | GAAGUAUAUUUUUUAUUGCAAUUUU | 1119 |
| MTARC1-1941 25 mer | Sense Strand | AGUAUAUUUUUUAUUGCCAAUUUGU | 1120 |
| MTARC1-1953 25 mer | Sense Strand | AUUGCCAUUUUGUCCUUUGAUUAUA | 1121 |
| MTARC1-1955 25 mer | Sense Strand | UGCCAUUUUGUCCUUUGAUAAUAUU | 1122 |
| MTARC1-1981 25 mer | Sense Strand | GGAAGUUGACUAAACUUGAAAAAUG | 1123 |

SEQUENCE LISTING

| Name | Strand | Sequence | SEQ ID NO |
|---|---|---|---|
| MTARC1-1983 | 25 mer Sense Strand | AAGUUGACUAAACUUGAAAAAUGUU | 1124 |
| MTARC1-1985 | 25 mer Sense Strand | GUUGACUAAACUUGAAAAAGUUUU | 1125 |
| MTARC1-1986 | 25 mer Sense Strand | UUGACUAAACUUGAAAAAUAUUUU | 1126 |
| MTARC1-1988 | 25 mer Sense Strand | GACUAAACUUGAAAAAUGUAUUUAA | 1127 |
| MTARC1-1989 | 25 mer Sense Strand | ACUAAACUUGAAAAAUGUUAUUAAA | 1128 |
| MTARC1-1990 | 25 mer Sense Strand | CUAAACUUGAAAAAUGUUUAUAAAA | 1129 |
| MTARC1-1995 | 25 mer Sense Strand | CUUGAAAAAUGUUUUAAAACUGUG | 1130 |
| MTARC1-1996 | 25 mer Sense Strand | UUGAAAAAUGUUUUUAAAAAUGUGA | 1131 |
| MTARC1-1998 | 25 mer Sense Strand | GAAAAAUGUUUUUAAAACUAUGAAU | 1132 |
| MTARC1-1999 | 25 mer Sense Strand | AAAAAUGUUUUUAAAACUGAGAAUA | 1133 |
| MTARC1-2000 | 25 mer Sense Strand | AAAAUGUUUUUAAAACUGUAAAUAA | 1134 |
| MTARC1-2001 | 25 mer Sense Strand | AAAUGUUUUUAAAACUGUGAAUAAA | 1135 |
| MTARC1-2002 | 25 mer Sense Strand | AAUGUUUUUAAAACUGUGAAUAAAU | 1136 |
| MTARC1-2005 | 25 mer Sense Strand | GUUUUUAAAACUGUGAAUAAAUGGA | 1137 |
| MTARC1-2006 | 25 mer Sense Strand | UUUUUAAAACUGUGAAUAAAUGGAA | 1138 |
| MTARC1-2010 | 25 mer Sense Strand | UAAAACUGUGAAUAAAUGGAAGCUA | 1139 |
| MTARC1-2011 | 25 mer Sense Strand | AAAACUGUGAAUAAAUGGAAGCUAC | 1140 |
| MTARC1-2012 | 25 mer Sense Strand | AAACUGUGAAUAAAUGGAAACUACU | 1141 |
| MTARC1-2013 | 25 mer Sense Strand | AACUGUGAAUAAAUGGAAGAUACUU | 1142 |
| MTARC1-2015 | 25 mer Sense Strand | CUGUGAAUAAAUGGAAGCUACUUUG | 1143 |
| MTARC1-2016 | 25 mer Sense Strand | UGUGAAUAAAUGGAAGCUAAUUUGA | 1144 |
| MTARC1-2017 | 25 mer Sense Strand | GUGAAUAAAUGGAAGCUACAUUGAC | 1145 |
| MTARC1-2018 | 25 mer Sense Strand | UGAAUAAAUGGAAGCUACUAUGACU | 1146 |
| MTARC1-2019 | 25 mer Sense Strand | GAAUAAAUGGAAGCUACUUAGACUA | 1147 |
| MTARC1-2020 | 25 mer Sense Strand | AAUAAAUGGAAGCUACUUUAACUAG | 1148 |
| MTARC1-2022 | 25 mer Sense Strand | UAAAUGGAAGCUACUUUGAAUAGUU | 1149 |
| MTARC1-2023 | 25 mer Sense Strand | AAAUGGAAGCUACUUUGACAAGUUU | 1150 |
| MTARC1-2025 | 25 mer Sense Strand | AUGGAAGCUACUUUGACUAAUUUCA | 1151 |
| MTARC1-2027 | 25 mer Sense Strand | GGAAGCUACUUUGACUAGUAUCAGA | 1152 |
| MTARC1-231 | 27 mer Anti-sense Strand | UCACAUGGUAGAUCCAGAGCUGCGCCA | 1153 |
| MTARC1-233 | 27 mer Anti-sense Strand | UUUCAUAGGGUAGAUCCAGAGCUGCGC | 1154 |
| MTARC1-234 | 27 mer Anti-sense Strand | AUUUCUCAGGGUAGAUCCAGAGCUGCG | 1155 |
| MTARC1-235 | 27 mer Anti-sense Strand | GAUUUUACAGGGUAGAUCCAGAGCUGC | 1156 |
| MTARC1-236 | 27 mer Anti-sense Strand | GGAUUUCACAGGGUAGAUCCAGAGCUG | 1157 |

-continued

SEQUENCE LISTING

| Name | Strand | Sequence | SEQ ID NO |
|---|---|---|---|
| MTARC1-237 | 27 mer Anti-sense Strand | AGGAUUUCACAGGGUAGAUCCAGAGCU | 1158 |
| MTARC1-238 | 27 mer Anti-sense Strand | CAGGAUUUCACAGGGUAGAUCCAGAGC | 1159 |
| MTARC1-239 | 27 mer Anti-sense Strand | GCAGGUUUUCACAGGGUAGAUCCAGAG | 1160 |
| MTARC1-240 | 27 mer Anti-sense Strand | UGCAGUAUUUCACAGGGUAGAUCCAGA | 1161 |
| MTARC1-241 | 27 mer Anti-sense Strand | UUGCAUGAUUUCACAGGGUAGAUCCAG | 1162 |
| MTARC1-242 | 27 mer Anti-sense Strand | CUUGCUGGAUUUCACAGGGUAGAUCCA | 1163 |
| MTARC1-243 | 27 mer Anti-sense Strand | CCUUGUAGGAUUUCACAGGGUAGAUCC | 1164 |
| MTARC1-244 | 27 mer Anti-sense Strand | CCCUUUCAGGAUUUCACAGGGUAGAUC | 1165 |
| MTARC1-245 | 27 mer Anti-sense Strand | CCCCUUGCAGGAUUUCACAGGGUAGAU | 1166 |
| MTARC1-247 | 27 mer Anti-sense Strand | ACCCCUUUGCAGGAUUUCACAGGGUAG | 1167 |
| MTARC1-248 | 27 mer Anti-sense Strand | CACCCUCUUGCAGGAUUUCACAGGGUA | 1168 |
| MTARC1-249 | 27 mer Anti-sense Strand | GCACCUCCUUGCAGGAUUUCACAGGGU | 1169 |
| MTARC1-253 | 27 mer Anti-sense Strand | ACCGGUACCCCUUGCAGGAUUUCACA | 1170 |
| MTARC1-255 | 27 mer Anti-sense Strand | UCACCUGCACCCCUUGCAGGAUUUCA | 1171 |
| MTARC1-318 | 27 mer Anti-sense Strand | CAAGCUAAAACCUGUCCCGCAGGUUGC | 1172 |
| MTARC1-319 | 27 mer Anti-sense Strand | ACAAGUCAAAACCUGUCCCGCAGGUUG | 1173 |
| MTARC1-320 | 27 mer Anti-sense Strand | CACAAUCCAAAACCUGUCCCGCAGGUU | 1174 |
| MTARC1-321 | 27 mer Anti-sense Strand | UCACAUGCCAAAACCUGUCCCGCAGGU | 1175 |
| MTARC1-323 | 27 mer Anti-sense Strand | GAUCAUAAGCCAAAACCUGUCCCGCAG | 1176 |
| MTARC1-324 | 27 mer Anti-sense Strand | UGAUCUCAAGCCAAAACCUGUCCCGCA | 1177 |
| MTARC1-325 | 27 mer Anti-sense Strand | UUGAUUACAAGCCAAAACCUGUCCCGC | 1178 |
| MTARC1-326 | 27 mer Anti-sense Strand | GUUGAUCACAAGCCAAAACCUGUCCCG | 1179 |
| MTARC1-327 | 27 mer Anti-sense Strand | GGUUGUUCACAAGCCAAAACCUGUCCC | 1180 |
| MTARC1-328 | 27 mer Anti-sense Strand | UGGUUUAUCACAAGCCAAAACCUGUCC | 1181 |

-continued

SEQUENCE LISTING

| Name | Strand | Sequence | SEQ ID NO |
|---|---|---|---|
| MTARC1-329 | 27 mer Anti-sense Strand | CUGGUUGAUCACAAGCCAAAACCUGUC | 1182 |
| MTARC1-330 | 27 mer Anti-sense Strand | CCUGGUUGAUCACAAGCCAAAACCUGU | 1183 |
| MTARC1-331 | 27 mer Anti-sense Strand | UCCUGUUUGAUCACAAGCCAAAACUG | 1184 |
| MTARC1-332 | 27 mer Anti-sense Strand | CUCCUUGUUGAUCACAAGCCAAAACCU | 1185 |
| MTARC1-334 | 27 mer Anti-sense Strand | CCCUCUUGGUUGAUCACAAGCCAAAAC | 1186 |
| MTARC1-335 | 27 mer Anti-sense Strand | UCCCUUCUGGUUGAUCACAAGCCAAAA | 1187 |
| MTARC1-337 | 27 mer Anti-sense Strand | UUUCCUUCCUGGUUGAUCACAAGCCAA | 1188 |
| MTARC1-338 | 27 mer Anti-sense Strand | GUUUCUCUCCUGGUUGAUCACAAGCCA | 1189 |
| MTARC1-339 | 27 mer Anti-sense Strand | UGUUUUCCUCCUGGUUGAUCACAAGCC | 1190 |
| MTARC1-340 | 27 mer Anti-sense Strand | AUGUUUCCCUCCUGGUUGAUCACAAGC | 1191 |
| MTARC1-341 | 27 mer Anti-sense Strand | CAUGUUUCCCUCCUGGUUGAUCACAAG | 1192 |
| MTARC1-342 | 27 mer Anti-sense Strand | CCAUGUUUCCCUCCUGGUUGAUCACAA | 1193 |
| MTARC1-343 | 27 mer Anti-sense Strand | ACCAUUUUUCCCUCCUGGUUGAUCACA | 1194 |
| MTARC1-345 | 27 mer Anti-sense Strand | UAACCUUGUUUCCCUCCUGGUUGAUCA | 1195 |
| MTARC1-346 | 27 mer Anti-sense Strand | GUAACUAUGUUUCCCUCCUGGUUGAUC | 1196 |
| MTARC1-347 | 27 mer Anti-sense Strand | AGUAAUCAUGUUUCCCUCCUGGUUGAU | 1197 |
| MTARC1-348 | 27 mer Anti-sense Strand | CAGUAUCCAUGUUUCCCUCCUGGUUGA | 1198 |
| MTARC1-349 | 27 mer Anti-sense Strand | GCAGUUACCAUGUUUCCCUCCUGGUUG | 1199 |
| MTARC1-350 | 27 mer Anti-sense Strand | AGCAGUAACCAUGUUUCCCUCCUGGUU | 1200 |
| MTARC1-351 | 27 mer Anti-sense Strand | GAGCAUUAACCAUGUUUCCCUCCUGGU | 1201 |
| MTARC1-352 | 27 mer Anti-sense Strand | CGAGCUGUAACCAUGUUUCCCUCCUGG | 1202 |
| MTARC1-353 | 27 mer Anti-sense Strand | GCGAGUAGUAACCAUGUUUCCCUCCUG | 1203 |
| MTARC1-354 | 27 mer Anti-sense Strand | GGCGAUCAGUAACCAUGUUUCCCUCCU | 1204 |
| MTARC1-356 | 27 mer Anti-sense Strand | CUGGCUAGCAGUAACCAUGUUUCCCUC | 1205 |

SEQUENCE LISTING

| Name | Strand | Sequence | SEQ ID NO |
|---|---|---|---|
| MTARC1-357 | 27 mer Anti-sense Strand | CCUGGUGAGCAGUAACCAUGUUUCCCU | 1206 |
| MTARC1-358 | 27 mer Anti-sense Strand | UCCUGUCGAGCAGUAACCAUGUUUCCC | 1207 |
| MTARC1-359 | 27 mer Anti-sense Strand | UUCCUUGCGAGCAGUAACCAUGUUUCC | 1208 |
| MTARC1-360 | 27 mer Anti-sense Strand | GUUCCUGGCGAGCAGUAACCAUGUUUC | 1209 |
| MTARC1-361 | 27 mer Anti-sense Strand | GGUUCUUGGCGAGCAGUAACCAUGUUU | 1210 |
| MTARC1-362 | 27 mer Anti-sense Strand | AGGUUUCUGGCGAGCAGUAACCAUGUU | 1211 |
| MTARC1-365 | 27 mer Anti-sense Strand | GCGAGUUUCCUGGCGAGCAGUAACCAU | 1212 |
| MTARC1-376 | 27 mer Anti-sense Strand | AUCAGUACCAGGCGAGGUUCCUGGCGA | 1213 |
| MTARC1-379 | 27 mer Anti-sense Strand | GAAAUUAGGACCAGGCGAGGUUCCUGG | 1214 |
| MTARC1-384 | 27 mer Anti-sense Strand | UCAGGUAAAUCAGGACCAGGCGAGGUU | 1215 |
| MTARC1-385 | 27 mer Anti-sense Strand | GUCAGUGAAAUCAGGACCAGGCGAGGU | 1216 |
| MTARC1-388 | 27 mer Anti-sense Strand | CAGGUUAGGGAAAUCAGGACCAGGCGA | 1217 |
| MTARC1-390 | 27 mer Anti-sense Strand | CGCAGUUCAGGGAAAUCAGGACCAGGC | 1218 |
| MTARC1-391 | 27 mer Anti-sense Strand | UCGCAUGUCAGGGAAAUCAGGACCAGG | 1219 |
| MTARC1-393 | 27 mer Anti-sense Strand | CAUCGUAGGUCAGGGAAAUCAGGACCA | 1220 |
| MTARC1-395 | 27 mer Anti-sense Strand | ACCAUUGCAGGUCAGGGAAAUCAGGAC | 1221 |
| MTARC1-405 | 27 mer Anti-sense Strand | UCAGGUUGUCACCAUCGCAGGUCAGGG | 1222 |
| MTARC1-409 | 27 mer Anti-sense Strand | AGAGUUAGGGUGUCACCAUCGCAGGUC | 1223 |
| MTARC1-411 | 27 mer Anti-sense Strand | UGAGAUUCAGGGUGUCACCAUCGCAGG | 1224 |
| MTARC1-412 | 27 mer Anti-sense Strand | CUGAGUGUCAGGGUGUCACCAUCGCAG | 1225 |
| MTARC1-413 | 27 mer Anti-sense Strand | ACUGAUAGUCAGGGUGUCACCAUCGCA | 1226 |
| MTARC1-414 | 27 mer Anti-sense Strand | CACUGUGAGUCAGGGUGUCACCAUCGC | 1227 |
| MTARC1-415 | 27 mer Anti-sense Strand | GCACUUAGAGUCAGGGUGUCACCAUCG | 1228 |
| MTARC1-416 | 27 mer Anti-sense Strand | UGCACUGAGAGUCAGGGUGUCACCAUC | 1229 |

SEQUENCE LISTING

| Name | Strand | Sequence | SEQ ID NO |
|---|---|---|---|
| MTARC1-417 | 27 mer Anti-sense Strand | CUGCAUUGAGAGUCAGGGUGUCACCAU | 1230 |
| MTARC1-418 | 27 mer Anti-sense Strand | GCUGCUCUGAGAGUCAGGGUGUCACCA | 1231 |
| MTARC1-419 | 27 mer Anti-sense Strand | GGCUGUACUGAGAGUCAGGGUGUCACC | 1232 |
| MTARC1-420 | 27 mer Anti-sense Strand | AGGCUUCACUGAGAGUCAGGGUGUCAC | 1233 |
| MTARC1-421 | 27 mer Anti-sense Strand | UAGGCUGCACUGAGAGUCAGGGUGUCA | 1234 |
| MTARC1-422 | 27 mer Anti-sense Strand | GUAGGUUGCACUGAGAGUCAGGGUGUC | 1235 |
| MTARC1-423 | 27 mer Anti-sense Strand | UGUAGUCUGCACUGAGAGUCAGGGUGU | 1236 |
| MTARC1-424 | 27 mer Anti-sense Strand | GUGUAUGCUGCACUGAGAGUCAGGGUG | 1237 |
| MTARC1-425 | 27 mer Anti-sense Strand | UGUGUUGGCUGCACUGAGAGUCAGGGU | 1238 |
| MTARC1-426 | 27 mer Anti-sense Strand | UUGUGUAGGCUGCACUGAGAGUCAGGG | 1239 |
| MTARC1-427 | 27 mer Anti-sense Strand | UUUGUUUAGGCUGCACUGAGAGUCAGG | 1240 |
| MTARC1-428 | 27 mer Anti-sense Strand | CUUUGUGUAGGCUGCACUGAGAGUCAG | 1241 |
| MTARC1-429 | 27 mer Anti-sense Strand | CCUUUUUGUAGGCUGCACUGAGAGUCA | 1242 |
| MTARC1-430 | 27 mer Anti-sense Strand | UCCUUUGUGUAGGCUGCACUGAGAGUC | 1243 |
| MTARC1-431 | 27 mer Anti-sense Strand | GUCCUUUGUGUAGGCUGCACUGAGAGU | 1244 |
| MTARC1-433 | 27 mer Anti-sense Strand | AGGUCUUUUGUGUAGGCUGCACUGAGA | 1245 |
| MTARC1-434 | 27 mer Anti-sense Strand | UAGGUUCUUUGUGUAGGCUGCACUGAG | 1246 |
| MTARC1-435 | 27 mer Anti-sense Strand | GUAGGUCCUUUGUGUAGGCUGCACUGA | 1247 |
| MTARC1-436 | 27 mer Anti-sense Strand | AGUAGUUCCUUUGUGUAGGCUGCACUG | 1248 |
| MTARC1-437 | 27 mer Anti-sense Strand | UAGUAUGUCCUUUGUGUAGGCUGCACU | 1249 |
| MTARC1-438 | 27 mer Anti-sense Strand | GUAGUUGGUCCUUUGUGUAGGCUGCAC | 1250 |
| MTARC1-439 | 27 mer Anti-sense Strand | AGUAGUAGGUCCUUUGUGUAGGCUGCA | 1251 |
| MTARC1-440 | 27 mer Anti-sense Strand | CAGUAUUAGGUCCUUUGUGUAGGCUGC | 1252 |
| MTARC1-441 | 27 mer Anti-sense Strand | GCAGUUGUAGGUCCUUUGUGUAGGCUG | 1253 |

-continued

SEQUENCE LISTING

| Name | Strand | Sequence | SEQ ID NO |
|---|---|---|---|
| MTARC1-445 | 27 mer Anti-sense Strand | AUAGGUAGUAGUAGGUCCUUUGUGUAG | 1254 |
| MTARC1-446 | 27 mer Anti-sense Strand | GAUAGUCAGUAGUAGGUCCUUUGUGUA | 1255 |
| MTARC1-447 | 27 mer Anti-sense Strand | UGAUAUGCAGUAGUAGGUCCUUUGUGU | 1256 |
| MTARC1-448 | 27 mer Anti-sense Strand | UUGAUUGGCAGUAGUAGGUCCUUUGUG | 1257 |
| MTARC1-449 | 27 mer Anti-sense Strand | UUUGAUAGGCAGUAGUAGGUCCUUUGU | 1258 |
| MTARC1-450 | 27 mer Anti-sense Strand | UUUUGUUAGGCAGUAGUAGGUCCUUUG | 1259 |
| MTARC1-451 | 27 mer Anti-sense Strand | GUUUUUAUAGGCAGUAGUAGGUCCUUU | 1260 |
| MTARC1-452 | 27 mer Anti-sense Strand | CGUUUUGAUAGGCAGUAGUAGGUCCUU | 1261 |
| MTARC1-453 | 27 mer Anti-sense Strand | GCGUUUUGAUAGGCAGUAGUAGGUCCU | 1262 |
| MTARC1-454 | 27 mer Anti-sense Strand | GGCGUUUUGAUAGGCAGUAGUAGGUCC | 1263 |
| MTARC1-456 | 27 mer Anti-sense Strand | UGGGCUUUUGAUAGGCAGUAGUAGGU | 1264 |
| MTARC1-457 | 27 mer Anti-sense Strand | GUGGGUGUUUUGAUAGGCAGUAGUAGG | 1265 |
| MTARC1-458 | 27 mer Anti-sense Strand | GGUGGUCGUUUUGAUAGGCAGUAGUAG | 1266 |
| MTARC1-459 | 27 mer Anti-sense Strand | UGGUGUGCGUUUUGAUAGGCAGUAGUA | 1267 |
| MTARC1-460 | 27 mer Anti-sense Strand | GUGGGUUGGCGUUUUGAUAGGCAGUAGU | 1268 |
| MTARC1-462 | 27 mer Anti-sense Strand | UUGUGUUGGGCGUUUUGAUAGGCAGUA | 1269 |
| MTARC1-468 | 27 mer Anti-sense Strand | CUGCAUUUGUGGUGGGCGUUUUGAUAG | 1270 |
| MTARC1-469 | 27 mer Anti-sense Strand | ACUGCUUUUGUGGUGGGCGUUUUGAUA | 1271 |
| MTARC1-470 | 27 mer Anti-sense Strand | CACUGUAUUUGUGGUGGGCGUUUUGAU | 1272 |
| MTARC1-471 | 27 mer Anti-sense Strand | GCACUUCAUUUGUGGUGGGCGUUUUGA | 1273 |
| MTARC1-473 | 27 mer Anti-sense Strand | GUGCAUUGCAUUUGUGGUGGGCGUUUU | 1274 |
| MTARC1-475 | 27 mer Anti-sense Strand | UUGUGUACUGCAUUUGUGGUGGGCGUU | 1275 |
| MTARC1-476 | 27 mer Anti-sense Strand | CUUGUUCACUGCAUUUGUGGUGGGCGU | 1276 |
| MTARC1-482 | 27 mer Anti-sense Strand | UCUGCUCUUGUGCACUGCAUUUGUGGU | 1277 |

-continued

SEQUENCE LISTING

| Name | Strand | Sequence | SEQ ID NO |
|---|---|---|---|
| MTARC1-483 | 27 mer Anti-sense Strand | CUCUGUACUUGUGCACUGCAUUUGUGG | 1278 |
| MTARC1-484 | 27 mer Anti-sense Strand | ACUCUUCACUUGUGCACUGCAUUUGUG | 1279 |
| MTARC1-552 | 27 mer Anti-sense Strand | UCAGGUAGCUGGUUAUCCACUGGGCGG | 1280 |
| MTARC1-553 | 27 mer Anti-sense Strand | UUCAGUAAGCUGGUUAUCCACUGGGCG | 1281 |
| MTARC1-554 | 27 mer Anti-sense Strand | CUUCAUGAAGCUGGUUAUCCACUGGGC | 1282 |
| MTARC1-555 | 27 mer Anti-sense Strand | ACUUCUGGAAGCUGGUUAUCCACUGGG | 1283 |
| MTARC1-556 | 27 mer Anti-sense Strand | GACUUUAGGAAGCUGGUUAUCCACUGG | 1284 |
| MTARC1-557 | 27 mer Anti-sense Strand | UGACUUCAGGAAGCUGGUUAUCCACUG | 1285 |
| MTARC1-558 | 27 mer Anti-sense Strand | GUGACUUCAGGAAGCUGGUUAUCCACU | 1286 |
| MTARC1-559 | 27 mer Anti-sense Strand | UGUGAUUUCAGGAAGCUGGUUAUCCAC | 1287 |
| MTARC1-560 | 27 mer Anti-sense Strand | CUGUGUCUUCAGGAAGCUGGUUAUCCA | 1288 |
| MTARC1-561 | 27 mer Anti-sense Strand | GCUGUUACUUCAGGAAGCUGGUUAUCC | 1289 |
| MTARC1-562 | 27 mer Anti-sense Strand | GGCUGUGACUUCAGGAAGCUGGUUAUC | 1290 |
| MTARC1-563 | 27 mer Anti-sense Strand | GGGCUUUGACUUCAGGAAGCUGGUUAU | 1291 |
| MTARC1-564 | 27 mer Anti-sense Strand | AGGGCUGUGACUUCAGGAAGCUGGUUA | 1292 |
| MTARC1-565 | 27 mer Anti-sense Strand | UAGGGUUGUGACUUCAGGAAGCUGGUU | 1293 |
| MTARC1-566 | 27 mer Anti-sense Strand | GUAGGUCUGUGACUUCAGGAAGCUGGU | 1294 |
| MTARC1-567 | 27 mer Anti-sense Strand | GGUAGUGCUGUGACUUCAGGAAGCUGG | 1295 |
| MTARC1-568 | 27 mer Anti-sense Strand | CGGUAUGGCUGUGACUUCAGGAAGCUG | 1296 |
| MTARC1-589 | 27 mer Anti-sense Strand | UGAGGUUCGAAGUGCACCAGGCGGUAG | 1297 |
| MTARC1-591 | 27 mer Anti-sense Strand | UGUGAUGCUCGAAGUGCACCAGGCGGU | 1298 |
| MTARC1-592 | 27 mer Anti-sense Strand | AUGUGUGGCUCGAAGUGCACCAGGCGG | 1299 |
| MTARC1-593 | 27 mer Anti-sense Strand | CAUGUUAGGCUCGAAGUGCACCAGGCG | 1300 |
| MTARC1-597 | 27 mer Anti-sense Strand | GUCGCUUGUGAGGCUCGAAGUGCACCA | 1301 |

-continued

SEQUENCE LISTING

| Name | Strand | Sequence | SEQ ID NO |
|---|---|---|---|
| MTARC1-600 | 27 mer Anti-sense Strand | UCGGUUGCAUGUGAGGCUCGAAGUGCA | 1302 |
| MTARC1-612 | 27 mer Anti-sense Strand | GAUGAUGACGUCUCGGUCGCAUGUGAG | 1303 |
| MTARC1-614 | 27 mer Anti-sense Strand | UUGAUUAGGACGUCUCGGUCGCAUGUG | 1304 |
| MTARC1-617 | 27 mer Anti-sense Strand | UAUUUUAUGAGGACGUCUCGGUCGCAU | 1305 |
| MTARC1-618 | 27 mer Anti-sense Strand | CUAUUUGAUGAGGACGUCUCGGUCGCA | 1306 |
| MTARC1-620 | 27 mer Anti-sense Strand | UGCUAUUUGAUGAGGACGUCUCGGUCG | 1307 |
| MTARC1-621 | 27 mer Anti-sense Strand | CUGCUUUUGAUGAGGACGUCUCGGUC | 1308 |
| MTARC1-622 | 27 mer Anti-sense Strand | UCUGCUAUUUGAUGAGGACGUCUCGGU | 1309 |
| MTARC1-623 | 27 mer Anti-sense Strand | GUCUGUUAUUUGAUGAGGACGUCUCGG | 1310 |
| MTARC1-624 | 27 mer Anti-sense Strand | AGUCUUCUAUUUGAUGAGGACGUCUCG | 1311 |
| MTARC1-625 | 27 mer Anti-sense Strand | AAGUCUGCUAUUUGAUGAGGACGUCUC | 1312 |
| MTARC1-626 | 27 mer Anti-sense Strand | CAAGUUUGCUAUUUGAUGAGGACGUCU | 1313 |
| MTARC1-627 | 27 mer Anti-sense Strand | ACAAGUCUGCUAUUUGAUGAGGACGUC | 1314 |
| MTARC1-628 | 27 mer Anti-sense Strand | AACAAUUCUGCUAUUUGAUGAGGACGU | 1315 |
| MTARC1-629 | 27 mer Anti-sense Strand | GAACAUGUCUGCUAUUUGAUGAGGACG | 1316 |
| MTARC1-630 | 27 mer Anti-sense Strand | GGAACUAGUCUGCUAUUUGAUGAGGAC | 1317 |
| MTARC1-631 | 27 mer Anti-sense Strand | CGGAAUAAGUCUGCUAUUUGAUGAGGA | 1318 |
| MTARC1-632 | 27 mer Anti-sense Strand | UCGGAUCAAGUCUGCUAUUUGAUGAGG | 1319 |
| MTARC1-633 | 27 mer Anti-sense Strand | GUCGGUACAAGUCUGCUAUUUGAUGAG | 1320 |
| MTARC1-634 | 27 mer Anti-sense Strand | GGUCGUAACAAGUCUGCUAUUUGAUGA | 1321 |
| MTARC1-635 | 27 mer Anti-sense Strand | GGGUCUGAACAAGUCUGCUAUUUGAUG | 1322 |
| MTARC1-636 | 27 mer Anti-sense Strand | UGGGUUGGAACAAGUCUGCUAUUUGAU | 1323 |
| MTARC1-637 | 27 mer Anti-sense Strand | UUGGGUCGGAACAAGUCUGCUAUUUGA | 1324 |
| MTARC1-638 | 27 mer Anti-sense Strand | CUUGGUUCGGAACAAGUCUGCUAUUUG | 1325 |

SEQUENCE LISTING

| Name | Strand | Sequence | SEQ ID NO |
|---|---|---|---|
| MTARC1-639 | 27 mer Anti-sense Strand | CCUUGUGUCGGAACAAGUCUGCUAUUU | 1326 |
| MTARC1-640 | 27 mer Anti-sense Strand | UCCUUUGGUCGGAACAAGUCUGCUAUU | 1327 |
| MTARC1-641 | 27 mer Anti-sense Strand | GUCCUUGGGUCGGAACAAGUCUGCUAU | 1328 |
| MTARC1-642 | 27 mer Anti-sense Strand | GGUCCUUGGGUCGGAACAAGUCUGCUA | 1329 |
| MTARC1-643 | 27 mer Anti-sense Strand | UGGUCUUUGGGUCGGAACAAGUCUGCU | 1330 |
| MTARC1-644 | 27 mer Anti-sense Strand | CUGGUUCUUGGGUCGGAACAAGUCUGC | 1331 |
| MTARC1-645 | 27 mer Anti-sense Strand | UCUGGUCCUUGGGUCGGAACAAGUCUG | 1332 |
| MTARC1-646 | 27 mer Anti-sense Strand | AUCUGUUCCUUGGGUCGGAACAAGUCU | 1333 |
| MTARC1-647 | 27 mer Anti-sense Strand | AAUCUUGUCCUUGGGUCGGAACAAGUC | 1334 |
| MTARC1-648 | 27 mer Anti-sense Strand | CAAUCUGGUCCUUGGGUCGGAACAAGU | 1335 |
| MTARC1-649 | 27 mer Anti-sense Strand | GCAAUUUGGUCCUUGGGUCGGAACAAG | 1336 |
| MTARC1-650 | 27 mer Anti-sense Strand | AGCAAUCUGGUCCUUGGGUCGGAACAA | 1337 |
| MTARC1-651 | 27 mer Anti-sense Strand | AAGCAUUCUGGUCCUUGGGUCGGAACA | 1338 |
| MTARC1-652 | 27 mer Anti-sense Strand | UAAGCUAUCUGGUCCUUGGGUCGGAAC | 1339 |
| MTARC1-653 | 27 mer Anti-sense Strand | GUAAGUAAUCUGGUCCUUGGGUCGGAA | 1340 |
| MTARC1-654 | 27 mer Anti-sense Strand | AGUAAUCAAUCUGGUCCUUGGGUCGGA | 1341 |
| MTARC1-655 | 27 mer Anti-sense Strand | GAGUAUGCAAUCUGGUCCUUGGGUCGG | 1342 |
| MTARC1-656 | 27 mer Anti-sense Strand | UGAGUUAGCAAUCUGGUCCUUGGGUCG | 1343 |
| MTARC1-657 | 27 mer Anti-sense Strand | CUGAGUAAGCAAUCUGGUCCUUGGGUC | 1344 |
| MTARC1-658 | 27 mer Anti-sense Strand | UCUGAUUAAGCAAUCUGGUCCUUGGGU | 1345 |
| MTARC1-659 | 27 mer Anti-sense Strand | GUCUGUGUAAGCAAUCUGGUCCUUGGG | 1346 |
| MTARC1-660 | 27 mer Anti-sense Strand | UGUCUUAGUAAGCAAUCUGGUCCUUGG | 1347 |
| MTARC1-661 | 27 mer Anti-sense Strand | GUGUCUGAGUAAGCAAUCUGGUCCUUG | 1348 |
| MTARC1-662 | 27 mer Anti-sense Strand | GGUGUUUGAGUAAGCAAUCUGGUCCUU | 1349 |

-continued

SEQUENCE LISTING

| Name | Strand | Sequence | SEQ ID NO |
|---|---|---|---|
| MTARC1-663 | 27 mer Anti-sense Strand | UGGUGUCUGAGUAAGCAAUCUGGUCCU | 1350 |
| MTARC1-664 | 27 mer Anti-sense Strand | CUGGUUUCUGAGUAAGCAAUCGGUCC | 1351 |
| MTARC1-665 | 27 mer Anti-sense Strand | GCUGGUGUCUGAGUAAGCAAUCUGGUC | 1352 |
| MTARC1-666 | 27 mer Anti-sense Strand | GGCUGUUGUCUGAGUAAGCAAUCUGGU | 1353 |
| MTARC1-667 | 27 mer Anti-sense Strand | GGGCUUGUGUCUGAGUAAGCAAUCUGG | 1354 |
| MTARC1-668 | 27 mer Anti-sense Strand | UGGGCUGGUGUCUGAGUAAGCAAUCUG | 1355 |
| MTARC1-669 | 27 mer Anti-sense Strand | AUGGGUUGGUGUCUGAGUAAGCAAUCU | 1356 |
| MTARC1-670 | 27 mer Anti-sense Strand | AAUGGUCUGGUGUCUGAGUAAGCAAUC | 1357 |
| MTARC1-671 | 27 mer Anti-sense Strand | GAAUGUGCUGGUGUCUGAGUAAGCAAU | 1358 |
| MTARC1-672 | 27 mer Anti-sense Strand | AGAAUUGGCUGGUGUCUGAGUAAGCAA | 1359 |
| MTARC1-673 | 27 mer Anti-sense Strand | AAGAAUGGGCUGGUGUCUGAGUAAGCA | 1360 |
| MTARC1-674 | 27 mer Anti-sense Strand | CAAGAUUGGGCUGGUGUCUGAGUAAGC | 1361 |
| MTARC1-675 | 27 mer Anti-sense Strand | UCAAGUAUGGGCUGGUGUCUGAGUAAG | 1362 |
| MTARC1-676 | 27 mer Anti-sense Strand | AUCAAUAAUGGGCUGGUGUCUGAGUAA | 1363 |
| MTARC1-677 | 27 mer Anti-sense Strand | GAUCAUGAAUGGGCUGGUGUCUGAGUA | 1364 |
| MTARC1-678 | 27 mer Anti-sense Strand | GGAUCUAGAAUGGGCUGGUGUCUGAGU | 1365 |
| MTARC1-679 | 27 mer Anti-sense Strand | AGGAUUAAGAAUGGGCUGGUGUCUGAG | 1366 |
| MTARC1-680 | 27 mer Anti-sense Strand | AAGGAUCAAGAAUGGGCUGGUGUCUGA | 1367 |
| MTARC1-681 | 27 mer Anti-sense Strand | AAAGGUUCAAGAAUGGGCUGGUGUCUG | 1368 |
| MTARC1-682 | 27 mer Anti-sense Strand | GAAAGUAUCAAGAAUGGGCUGGUGUCU | 1369 |
| MTARC1-683 | 27 mer Anti-sense Strand | AGAAAUGAUCAAGAAUGGGCUGGUGUC | 1370 |
| MTARC1-684 | 27 mer Anti-sense Strand | CAGAAUGGAUCAAGAAUGGGCUGGUGU | 1371 |
| MTARC1-685 | 27 mer Anti-sense Strand | UCAGAUAGGAUCAAGAAUGGGCUGGUG | 1372 |
| MTARC1-686 | 27 mer Anti-sense Strand | CUCAGUAAGGAUCAAGAAUGGGCUGGU | 1373 |

SEQUENCE LISTING

| Name | Strand | Sequence | SEQ ID NO |
|---|---|---|---|
| MTARC1-687 | 27 mer Anti-sense Strand | CCUCAUAAAGGAUCAAGAAUGGGCUGG | 1374 |
| MTARC1-691 | 27 mer Anti-sense Strand | GACGCUUCAGAAAGGAUCAAGAAUGGG | 1375 |
| MTARC1-692 | 27 mer Anti-sense Strand | CGACGUCUCAGAAAGGAUCAAGAAUGG | 1376 |
| MTARC1-724 | 27 mer Anti-sense Strand | UUCUUUUCUAGCCUGGAGUUGAGAUCC | 1377 |
| MTARC1-726 | 27 mer Anti-sense Strand | CUUUCUUCUCUAGCCUGGAGUUGAGAU | 1378 |
| MTARC1-728 | 27 mer Anti-sense Strand | AACUUUCUUCUCUAGCCUGGAGUUGAG | 1379 |
| MTARC1-729 | 27 mer Anti-sense Strand | UAACUUUCUUCUCUAGCCUGGAGUUGA | 1380 |
| MTARC1-730 | 27 mer Anti-sense Strand | UUAACUUUCUUCUCUAGCCUGGAGUUG | 1381 |
| MTARC1-731 | 27 mer Anti-sense Strand | UUUAAUUUUCUUCUCUAGCCUGGAGUU | 1382 |
| MTARC1-733 | 27 mer Anti-sense Strand | GCUUUUACUUUCUUCUCUAGCCUGGAG | 1383 |
| MTARC1-734 | 27 mer Anti-sense Strand | UGCUUUAACUUUCUUCUCUAGCCUGGA | 1384 |
| MTARC1-735 | 27 mer Anti-sense Strand | UUGCUUUAACUUUCUUCUCUAGCCUGG | 1385 |
| MTARC1-736 | 27 mer Anti-sense Strand | GUUGCUUUAACUUUCUUCUCUAGCCUG | 1386 |
| MTARC1-737 | 27 mer Anti-sense Strand | GGUUGUUUUAACUUUCUUCUCUAGCCU | 1387 |
| MTARC1-738 | 27 mer Anti-sense Strand | UGGUUUCUUUAACUUUCUUCUCUAGCC | 1388 |
| MTARC1-739 | 27 mer Anti-sense Strand | UUGGUUGCUUUAACUUUCUUCUCUAGC | 1389 |
| MTARC1-740 | 27 mer Anti-sense Strand | GUUGGUUGCUUUAACUUUCUUCUCUAG | 1390 |
| MTARC1-741 | 27 mer Anti-sense Strand | AGUUGUUUGCUUUAACUUUCUUCUCUA | 1391 |
| MTARC1-742 | 27 mer Anti-sense Strand | AAGUUUGUUGCUUUAACUUUCUUCUCU | 1392 |
| MTARC1-743 | 27 mer Anti-sense Strand | GAAGUUGGUUGCUUUAACUUUCUUCUC | 1393 |
| MTARC1-744 | 27 mer Anti-sense Strand | UGAAGUUGGUUGCUUUAACUUUCUUCU | 1394 |
| MTARC1-745 | 27 mer Anti-sense Strand | CUGAAUUGGUUGCUUUAACUUUCUUC | 1395 |
| MTARC1-746 | 27 mer Anti-sense Strand | CCUGAUGUUGGUUGCUUUAACUUUCUU | 1396 |
| MTARC1-747 | 27 mer Anti-sense Strand | GCCUGUAGUUGGUUGCUUUAACUUUCU | 1397 |

-continued

SEQUENCE LISTING

| Name | Strand | Sequence | SEQ ID NO |
|---|---|---|---|
| MTARC1-748 | 27 mer Anti-sense Strand | GGCCUUAAGUUGGUUGCUUUAACUUUC | 1398 |
| MTARC1-750 | 27 mer Anti-sense Strand | UGGGCUUGAAGUUGGUUGCUUUAACUU | 1399 |
| MTARC1-751 | 27 mer Anti-sense Strand | UUGGGUCUGAAGUUGGUUGCUUUAACU | 1400 |
| MTARC1-752 | 27 mer Anti-sense Strand | AUUGGUCCUGAAGUUGGUUGCUUUAAC | 1401 |
| MTARC1-753 | 27 mer Anti-sense Strand | UAUUGUGCCUGAAGUUGGUUGCUUUAA | 1402 |
| MTARC1-754 | 27 mer Anti-sense Strand | AUAUUUGGCCUGAAGUUGGUUGCUUUA | 1403 |
| MTARC1-755 | 27 mer Anti-sense Strand | AAUAUUGGGCCUGAAGUUGGUUGCUUU | 1404 |
| MTARC1-756 | 27 mer Anti-sense Strand | CAAUAUUGGGCCUGAAGUUGGUUGCUU | 1405 |
| MTARC1-758 | 27 mer Anti-sense Strand | UACAAUAUUGGGCCUGAAGUUGGUUGC | 1406 |
| MTARC1-759 | 27 mer Anti-sense Strand | UUACAUUAUUGGGCCUGAAGUUGGUUG | 1407 |
| MTARC1-760 | 27 mer Anti-sense Strand | AUUACUAUAUUGGGCCUGAAGUUGGUU | 1408 |
| MTARC1-761 | 27 mer Anti-sense Strand | AAUUAUAAUAUUGGGCCUGAAGUUGGU | 1409 |
| MTARC1-762 | 27 mer Anti-sense Strand | AAAUUUCAAUAUUGGGCCUGAAGUUGG | 1410 |
| MTARC1-763 | 27 mer Anti-sense Strand | GAAAUUACAAUAUUGGGCCUGAAGUUG | 1411 |
| MTARC1-764 | 27 mer Anti-sense Strand | UGAAAUUACAAUAUUGGGCCUGAAGUU | 1412 |
| MTARC1-765 | 27 mer Anti-sense Strand | CUGAAUUUACAAUAUUGGGCCUGAAGU | 1413 |
| MTARC1-766 | 27 mer Anti-sense Strand | CCUGAUAUUACAAUAUUGGGCCUGAAG | 1414 |
| MTARC1-767 | 27 mer Anti-sense Strand | UCCUGUAAUUACAAUAUUGGGCCUGAA | 1415 |
| MTARC1-768 | 27 mer Anti-sense Strand | AUCCUUAAAUUACAAUAUUGGGCCUGA | 1416 |
| MTARC1-769 | 27 mer Anti-sense Strand | CAUCCUGAAAUUACAAUAUUGGGCCUG | 1417 |
| MTARC1-770 | 27 mer Anti-sense Strand | GCAUCUUGAAAUUACAAUAUUGGGCCU | 1418 |
| MTARC1-771 | 27 mer Anti-sense Strand | CGCAUUCUGAAAUUACAAUAUUGGGCC | 1419 |
| MTARC1-772 | 27 mer Anti-sense Strand | UCGCAUCCUGAAAUUACAAUAUUGGGC | 1420 |
| MTARC1-773 | 27 mer Anti-sense Strand | AUCGCUUCCUGAAAUUACAAUAUUGGG | 1421 |

SEQUENCE LISTING

| Name | Strand | Sequence | SEQ ID NO |
|---|---|---|---|
| MTARC1-774 | 27 mer Anti-sense Strand | CAUCGUAUCCUGAAAUUACAAUAUUGG | 1422 |
| MTARC1-775 | 27 mer Anti-sense Strand | ACAUCUCAUCCUGAAAUUACAAUAUUG | 1423 |
| MTARC1-776 | 27 mer Anti-sense Strand | GACAUUGCAUCCUGAAAUUACAAUAUU | 1424 |
| MTARC1-777 | 27 mer Anti-sense Strand | AGACAUCGCAUCCUGAAAUUACAAUAU | 1425 |
| MTARC1-778 | 27 mer Anti-sense Strand | UAGACUUCGCAUCCUGAAAUUACAAUA | 1426 |
| MTARC1-779 | 27 mer Anti-sense Strand | AUAGAUAUCGCAUCCUGAAAUUACAAU | 1427 |
| MTARC1-780 | 27 mer Anti-sense Strand | CAUAGUCAUCGCAUCCUGAAAUUACAA | 1428 |
| MTARC1-781 | 27 mer Anti-sense Strand | GCAUAUACAUCGCAUCCUGAAAUUACA | 1429 |
| MTARC1-782 | 27 mer Anti-sense Strand | UGCAUUGACAUCGCAUCCUGAAAUUAC | 1430 |
| MTARC1-783 | 27 mer Anti-sense Strand | CUGCAUAGACAUCGCAUCCUGAAAUUA | 1431 |
| MTARC1-784 | 27 mer Anti-sense Strand | UCUGCUUAGACAUCGCAUCCUGAAAUU | 1432 |
| MTARC1-785 | 27 mer Anti-sense Strand | CUCUGUAUAGACAUCGCAUCCUGAAAU | 1433 |
| MTARC1-786 | 27 mer Anti-sense Strand | CCUCUUCAUAGACAUCGCAUCCUGAAA | 1434 |
| MTARC1-787 | 27 mer Anti-sense Strand | UCCUCUGCAUAGACAUCGCAUCCUGAA | 1435 |
| MTARC1-788 | 27 mer Anti-sense Strand | AUCCUUUGCAUAGACAUCGCAUCCUGA | 1436 |
| MTARC1-789 | 27 mer Anti-sense Strand | AAUCCUCUGCAUAGACAUCGCAUCCUG | 1437 |
| MTARC1-790 | 27 mer Anti-sense Strand | GAAUCUUCUGCAUAGACAUCGCAUCCU | 1438 |
| MTARC1-791 | 27 mer Anti-sense Strand | AGAAUUCUCUGCAUAGACAUCGCAUCC | 1439 |
| MTARC1-792 | 27 mer Anti-sense Strand | GUGUUUCCUCUGCAUAGACAUCGCAUC | 1440 |
| MTARC1-863 | 27 mer Anti-sense Strand | UGUGGUUAAAAUGCAUCUGGAACAAGC | 1441 |
| MTARC1-929 | 27 mer Anti-sense Strand | CUGGCUAUAACUCUUCAGUGUUUCCAG | 1442 |
| MTARC1-930 | 27 mer Anti-sense Strand | ACUGGUGAUAACUCUUCAGUGUUUCCA | 1443 |
| MTARC1-934 | 27 mer Anti-sense Strand | UCACAUUGGCGAUAACUCUUCAGUGUU | 1444 |
| MTARC1-955 | 27 mer Anti-sense Strand | UAUAAUUUUCGUUCUGAAGGGUCACAC | 1445 |

-continued

SEQUENCE LISTING

| Name | Strand | Sequence | SEQ ID NO |
|---|---|---|---|
| MTARC1-959 | 27 mer Anti-sense Strand | UCCAUUUAACUUUCGUUCUGAAGGGUC | 1446 |
| MTARC1-960 | 27 mer Anti-sense Strand | UUCCAUAUAACUUUCGUUCUGAAGGGU | 1447 |
| MTARC1-963 | 27 mer Anti-sense Strand | AUUUUUCAUAUAACUUUCGUUCUGAAG | 1448 |
| MTARC1-964 | 27 mer Anti-sense Strand | GAUUUUCCAUAUAACUUUCGUUCUGAA | 1449 |
| MTARC1-965 | 27 mer Anti-sense Strand | UGAUUUUCCAUAUAACUUUCGUUCUGA | 1450 |
| MTARC1-966 | 27 mer Anti-sense Strand | GUGAUUUUCCAUAUAACUUUCGUUCUG | 1451 |
| MTARC1-967 | 27 mer Anti-sense Strand | GGUGAUUUUCCAUAUAACUUUCGUUCU | 1452 |
| MTARC1-969 | 27 mer Anti-sense Strand | GUGGUUAUUUUCCAUAUAACUUUCGUU | 1453 |
| MTARC1-970 | 27 mer Anti-sense Strand | AGUGGUGAUUUUCCAUAUAACUUUCGU | 1454 |
| MTARC1-971 | 27 mer Anti-sense Strand | GAGUGUUGAUUUUCCAUAUAACUUUCG | 1455 |
| MTARC1-1107 | 27 mer Anti-sense Strand | UGUUGUCAUUUUUGAGAACAUUUUUAA | 1456 |
| MTARC1-1113 | 27 mer Anti-sense Strand | UUCAAUUGUUGUCAUUUUUGAGAACAU | 1457 |
| MTARC1-1118 | 27 mer Anti-sense Strand | CAUGCUUCAAGUGUUGUCAUUUUUGAG | 1458 |
| MTARC1-1123 | 27 mer Anti-sense Strand | AACACUAUGCUUCAAGUGUUGUCAUUU | 1459 |
| MTARC1-1126 | 27 mer Anti-sense Strand | UGAAAUACCAUGCUUCAAGUGUUGUCA | 1460 |
| MTARC1-1127 | 27 mer Anti-sense Strand | CUGAAUCACCAUGCUUCAAGUGUUGUC | 1461 |
| MTARC1-1128 | 27 mer Anti-sense Strand | UCUGAUACACCAUGCUUCAAGUGUUGU | 1462 |
| MTARC1-1129 | 27 mer Anti-sense Strand | UUCUGUAACACCAUGCUUCAAGUGUUG | 1463 |
| MTARC1-1130 | 27 mer Anti-sense Strand | GUUCUUAAACACCAUGCUUCAAGUGUU | 1464 |
| MTARC1-1132 | 27 mer Anti-sense Strand | CAGUUUUGAAACACCAUGCUUCAAGUG | 1465 |
| MTARC1-1133 | 27 mer Anti-sense Strand | UCAGUUCUGAAACACCAUGCUUCAAGU | 1466 |
| MTARC1-1134 | 27 mer Anti-sense Strand | CUCAGUUCUGAAACACCAUGCUUCAAG | 1467 |
| MTARC1-1135 | 27 mer Anti-sense Strand | UCUCAUUUCUGAAACACCAUGCUUCAA | 1468 |
| MTARC1-1139 | 27 mer Anti-sense Strand | GAGGUUUCAGUUCUGAAACACCAUGCU | 1469 |

SEQUENCE LISTING

| Name | Strand | Sequence | SEQ ID NO |
|---|---|---|---|
| MTARC1-1144 27 mer | Anti-sense Strand | AUGUAUAGGUCUCAGUUCUGAAACACC | 1470 |
| MTARC1-1165 27 mer | Anti-sense Strand | AAAAUUACAAAUUUAAAGAAAAUGUAG | 1471 |
| MTARC1-1167 27 mer | Anti-sense Strand | UGAAAUUCACAAAUUUAAAGAAAAUGU | 1472 |
| MTARC1-1173 27 mer | Anti-sense Strand | AAAAUUUGAAAAUCACAAAUUUAAAGA | 1473 |
| MTARC1-1177 27 mer | Anti-sense Strand | ACGAAUAAUGUGAAAAUCACAAAUUUA | 1474 |
| MTARC1-1179 27 mer | Anti-sense Strand | AGACGUAAAAUGUGAAAAUCACAAAUU | 1475 |
| MTARC1-1329 27 mer | Anti-sense Strand | AGAACUAUUCCAUAAUCAGUUAAACGG | 1476 |
| MTARC1-1330 27 mer | Anti-sense Strand | AAGAAUUAUUCCAUAAUCAGUUAAACG | 1477 |
| MTARC1-1332 27 mer | Anti-sense Strand | GAAAGUACUAUUCCAUAAUCAGUUAAA | 1478 |
| MTARC1-1333 27 mer | Anti-sense Strand | AGAAAUAACUAUUCCAUAAUCAGUUAA | 1479 |
| MTARC1-1334 27 mer | Anti-sense Strand | GAGAAUGAACUAUUCCAUAAUCAGUUA | 1480 |
| MTARC1-1335 27 mer | Anti-sense Strand | GGAGAUAGAACUAUUCCAUAAUCAGUU | 1481 |
| MTARC1-1620 27 mer | Anti-sense Strand | CAGAUUUAUGGAAAAUUAAUAUCUGCA | 1482 |
| MTARC1-1622 27 mer | Anti-sense Strand | UCCAGUUCUAUGGAAAAUUAAUAUCUG | 1483 |
| MTARC1-1660 27 mer | Anti-sense Strand | AGGAAUUCCAAUGCUGUCUGAGAAGCA | 1484 |
| MTARC1-1663 27 mer | Anti-sense Strand | UUUAGUAAAUCCAAUGCUGUCUGAGAA | 1485 |
| MTARC1-1664 27 mer | Anti-sense Strand | CUUUAUGAAAUCCAAUGCUGUCUGAGA | 1486 |
| MTARC1-1812 27 mer | Anti-sense Strand | UCUGAUAUCACUGAAUCACUUUUCUUC | 1487 |
| MTARC1-1816 27 mer | Anti-sense Strand | UCUAUUUGAAAUCACUGAAUCACUUUU | 1488 |
| MTARC1-1868 27 mer | Anti-sense Strand | UUUAAUCAACUGACAUAUGCUUUCCUU | 1489 |
| MTARC1-1869 27 mer | Anti-sense Strand | UUUUAUACAACUGACAUAUGCUUUCCU | 1490 |
| MTARC1-1876 27 mer | Anti-sense Strand | UAUUGUGUUUUAAACAACUGACAUAUG | 1491 |
| MTARC1-1877 27 mer | Anti-sense Strand | AUAUUUGGUUUUAAACAACUGACAUAU | 1492 |
| MTARC1-1878 27 mer | Anti-sense Strand | GAUAUUGGGUUUUAAACAACUGACAUA | 1493 |

SEQUENCE LISTING

| Name | Strand | Sequence | SEQ ID NO |
|---|---|---|---|
| MTARC1-1879 | 27 mer Anti-sense Strand | AGAUAUUGGGUUUUAAACAACUGACAU | 1494 |
| MTARC1-1882 | 27 mer Anti-sense Strand | AAUAGUUAUUGGGUUUUAAACAACUGA | 1495 |
| MTARC1-1883 | 27 mer Anti-sense Strand | AAAUAUAUUGGGUUUUAAACAACUG | 1496 |
| MTARC1-1884 | 27 mer Anti-sense Strand | AAAAUUGAUAUUGGGUUUUAAACAACU | 1497 |
| MTARC1-1885 | 27 mer Anti-sense Strand | AAAAAUAGAUAUUGGGUUUUAAACAAC | 1498 |
| MTARC1-1886 | 27 mer Anti-sense Strand | AAAAAUUAGAUAUUGGGUUUUAAACAA | 1499 |
| MTARC1-1935 | 27 mer Anti-sense Strand | UGGCAUUAAAAAAUAUACUUCAUCAGA | 1500 |
| MTARC1-1936 | 27 mer Anti-sense Strand | AUGGCUAUAAAAAAUAUACUUCAUCAG | 1501 |
| MTARC1-1937 | 27 mer Anti-sense Strand | AAUGGUAAUAAAAAAUAUACUUCAUCA | 1502 |
| MTARC1-1939 | 27 mer Anti-sense Strand | AAAAUUGCAAUAAAAAAUAUACUUCAU | 1503 |
| MTARC1-1941 | 27 mer Anti-sense Strand | ACAAAUUGGCAAUAAAAAAUAUACUUC | 1504 |
| MTARC1-1953 | 27 mer Anti-sense Strand | UAUAAUCAAAGGACAAAAUGGCAAUAA | 1505 |
| MTARC1-1955 | 27 mer Anti-sense Strand | AAUAUUAUCAAAGGACAAAAUGGCAAU | 1506 |
| MTARC1-1981 | 27 mer Anti-sense Strand | CAUUUUUCAAGUUUAGUCAACUUCCCA | 1507 |
| MTARC1-1983 | 27 mer Anti-sense Strand | AACAUUUUUCAAGUUUAGUCAACUUCC | 1508 |
| MTARC1-1985 | 27 mer Anti-sense Strand | AAAACUUUUUUCAAGUUUAGUCAACUU | 1509 |
| MTARC1-1986 | 27 mer Anti-sense Strand | AAAAAUAUUUUUCAAGUUUAGUCAACU | 1510 |
| MTARC1-1988 | 27 mer Anti-sense Strand | UUAAAUACAUUUUUCAAGUUUAGUCAA | 1511 |
| MTARC1-1989 | 27 mer Anti-sense Strand | UUUAAUAACAUUUUUCAAGUUUAGUCA | 1512 |
| MTARC1-1990 | 27 mer Anti-sense Strand | UUUUAUAAACAUUUUUCAAGUUUAGUC | 1513 |
| MTARC1-1995 | 27 mer Anti-sense Strand | CACAGUUUUAAAAACAUUUUUCAAGUU | 1514 |
| MTARC1-1996 | 27 mer Anti-sense Strand | UCACAUUUUUAAAAACAUUUUUCAAGU | 1515 |
| MTARC1-1998 | 27 mer Anti-sense Strand | AUUCAUAGUUUUAAAAACAUUUUUCAA | 1516 |
| MTARC1-1999 | 27 mer Anti-sense Strand | UAUUCUCAGUUUUAAAAACAUUUUUCA | 1517 |

-continued

SEQUENCE LISTING

| Name | Strand | Sequence | SEQ ID NO |
|---|---|---|---|
| MTARC1-2000 | 27 mer Anti-sense Strand | UUAUUUACAGUUUUAAAAACAUUU UUC | 1518 |
| MTARC1-2001 | 27 mer Anti-sense Strand | UUUAUUCACAGUUUUAAAAACAUU UUU | 1519 |
| MTARC1-2002 | 27 mer Anti-sense Strand | AUUUAUUCACAGUUUUAAAAACAU UUU | 1520 |
| MTARC1-2005 | 27 mer Anti-sense Strand | UCCAUUUAUUCACAGUUUUAAAAA CAU | 1521 |
| MTARC1-2006 | 27 mer Anti-sense Strand | UUCCAUUUAUUCACAGUUUUAAAA ACA | 1522 |
| MTARC1-2010 | 27 mer Anti-sense Strand | UAGCUUCCAUUUAUUCACAGUUUU AAA | 1523 |
| MTARC1-2011 | 27 mer Anti-sense Strand | GUAGCUUCCAUUUAUUCACAGUUU UAA | 1524 |
| MTARC1-2012 | 27 mer Anti-sense Strand | AGUAGUUUCCAUUUAUUCACAGUU UUA | 1525 |
| MTARC1-2013 | 27 mer Anti-sense Strand | AAGUAUCUUCCAUUUAUUCACAGU UUU | 1526 |
| MTARC1-2015 | 27 mer Anti-sense Strand | CAAAGUAGCUUCCAUUUAUUCACA GUU | 1527 |
| MTARC1-2016 | 27 mer Anti-sense Strand | UCAAAUUAGCUUCCAUUUAUUCAC AGU | 1528 |
| MTARC1-2017 | 27 mer Anti-sense Strand | GUCAAUGUAGCUUCCAUUUAUUCA CAG | 1529 |
| MTARC1-2018 | 27 mer Anti-sense Strand | AGUCAUAGUAGCUUCCAUUUAUUC ACA | 1530 |
| MTARC1-2019 | 27 mer Anti-sense Strand | UAGUCUAAGUAGCUUCCAUUUAUU CAC | 1531 |
| MTARC1-2020 | 27 mer Anti-sense Strand | CUAGUUAAAGUAGCUUCCAUUUAU UCA | 1532 |
| MTARC1-2022 | 27 mer Anti-sense Strand | AACUAUUCAAAGUAGCUUCCAUUU AUU | 1533 |
| MTARC1-2023 | 27 mer Anti-sense Strand | AAACUUGUCAAAGUAGCUUCCAUU UAU | 1534 |
| MTARC1-2025 | 27 mer Anti-sense Strand | UGAAAUUAGUCAAAGUAGCUUCCA UUU | 1535 |
| MTARC1-2027 | 27 mer Anti-sense Strand | UCUGAUACUAGUCAAAGUAGCUUC CAU | 1536 |
| MARC1-0324 | 36 mer Sense Strand | CGGGACAGGUUUUGGCUUGAGCAG CCGAAAGGCUGC | 1537 |
| MARC1-0326 | 36 mer Sense Strand | GGACAGGUUUUGGCUUGUGAGCAG CCGAAAGGCUGC | 1538 |
| MARC1-0327 | 36 mer Sense Strand | GACAGGUUUUGGCUUGUGAAGCAG CCGAAAGGCUGC | 1539 |
| MARC1-0330 | 36 mer Sense Strand | AGGUUUUGGCUUGUGAUCAAGCAG CCGAAAGGCUGC | 1540 |
| MARC1-0331 | 36 mer Sense Strand | GGUUUUGGCUUGUGAUCAAAGCAG CCGAAAGGCUGC | 1541 |

-continued

| Name | Strand | Sequence | SEQ ID NO |
|---|---|---|---|
| MARC1-0735 | 36 mer Sense Strand | AGGCUAGAGAAGAAAGUUAAGCAG CCGAAAGGCUGC | 1542 |
| MARC1-0736 | 36 mer Sense Strand | GGCUAGAGAAGAAAGUUAAGCAG CCGAAAGGCUGC | 1543 |
| MARC1-0788 | 36 mer Sense Strand | AGGAUGCGAUGUCUAUGCAAGCAG CCGAAAGGCUGC | 1544 |
| MARC1-0863 | 36 mer Sense Strand | UUGUUCCAGAUGCAUUUUAAGCAG CCGAAAGGCUGC | 1545 |
| MARC1-1179 | 36 mer Sense Strand | UUUGUGAUUUUCACAUUUUAGCAG CCGAAAGGCUGC | 1546 |
| MARC1-2012 | 36 mer Sense Strand | AAACUGUGAAUAAAUGGAAAGCAG CCGAAAGGCUGC | 1547 |
| MARC1-2013 | 36 mer Sense Strand | AACUGUGAAUAAAUGGAAGAGCAG CCGAAAGGCUGC | 1548 |
| MARC1-0661 | 36 mer Sense Strand | AGGACCAGAUUGCUUACUCAGCAG CCGAAAGGCUGC | 1549 |
| MARC1-1869 | 36 mer Sense Strand | GAAAGCAUAUGUCAGUUGUAGCAG CCGAAAGGCUGC | 1550 |
| MARC1-1876 | 36 mer Sense Strand | UAUGUCAGUUGUUUAAAACAGCAG CCGAAAGGCUGC | 1551 |
| MARC1-1886 | 36 mer Sense Strand | GUUUAAAACCCAAUAUCUAAGCAG CCGAAAGGCUGC | 1552 |
| MARC1-2016 | 36 mer Sense Strand | UGUGAAUAAAUGGAAGCUAAGCAG CCGAAAGGCUGC | 1553 |
| MARC1-0413 | 36 mer Sense Strand | CGAUGGUGACACCCUGACUAGCAG CCGAAAGGCUGC | 1554 |
| MARC1-0416 | 36 mer Sense Strand | UGGUGACACCCUGACUCUCAGCAG CCGAAAGGCUGC | 1555 |
| MARC1-0622 | 36 mer Sense Strand | CGAGACGUCCUCAUCAAAUAGCAG CCGAAAGGCUGC | 1556 |
| MARC1-0638 | 36 mer Sense Strand | AAUAGCAGACUUGUUCCGAAGCAG CCGAAAGGCUGC | 1557 |
| MARC1-0657 | 36 mer Sense Strand | CCCAAGGACCAGAUUGCUUAGCAG CCGAAAGGCUGC | 1558 |
| MARC1-0660 | 36 mer Sense Strand | AAGGACCAGAUUGCUUACUAGCAG CCGAAAGGCUGC | 1559 |
| MARC1-0965 | 36 mer Sense Strand | AGAACGAAAGUUAUAUGGAAGCAG CCGAAAGGCUGC | 1560 |
| MARC1-0966 | 36 mer Sense Strand | GAACGAAAGUUAUAUGGAAAGCAG CCGAAAGGCUGC | 1561 |
| MARC1-0967 | 36 mer Sense Strand | AACGAAAGUUAUAUGGAAAAGCAG CCGAAAGGCUGC | 1562 |
| MARC1-0969 | 36 mer Sense Strand | CGAAAGUUAUAUGGAAAAUAGCAG CCGAAAGGCUGC | 1563 |
| MARC1-1177 | 36 mer Sense Strand | AAUUGUGAUUUUCACAUUAGCAG CCGAAAGGCUGC | 1564 |
| MARC1-1884 | 36 mer Sense Strand | UUGUUUAAAACCCAAUAUCAGCAG CCGAAAGGCUGC | 1565 |

-continued

SEQUENCE LISTING

| Name | Strand | Sequence | SEQ ID NO |
|---|---|---|---|
| MARC1-1885 | 36 mer Sense Strand | UGUUUAAAACCCAAUAUCUAGCAGCCGAAAGGCUGC | 1566 |
| MARC1-1955 | 36 mer Sense Strand | UGCCAUUUUGUCCUUUGAUAGCAGCCGAAAGGCUGC | 1567 |
| MARC1-1983 | 36 mer Sense Strand | AAGUUGACUAAACUUGAAAAGCAGCCGAAAGGCUGC | 1568 |
| MARC1-1986 | 36 mer Sense Strand | UUGACUAAACUUGAAAAUAGCAGCCGAAAGGCUGC | 1569 |
| MARC1-2011 | 36 mer Sense Strand | AAAACUGUGAAUAAAUGGAAGCAGCCGAAAGGCUGC | 1570 |
| MARC1-1113 | 36 mer Sense Strand | CGAGCAAGCACUAUAUGGAAGCAGCCGAAAGGCUGC | 1571 |
| MARC1-1575 | 36 mer Sense Strand | AAGAAUGUUCCAGAAUGUUAGCAGCCGAAAGGCUGC | 1572 |
| MARC1-0324 | 22 mer Anti-sense Strand | UCAAGCCAAAACCUGUCCCGGG | 1573 |
| MARC1-0326 | 22 mer Anti-sense Strand | UCACAAGCCAAAACCUGUCCGG | 1574 |
| MARC1-0327 | 22 mer Anti-sense Strand | UUCACAAGCCAAAACCUGUCGG | 1575 |
| MARC1-0330 | 22 mer Anti-sense Strand | UUGAUCACAAGCCAAAACCUGG | 1576 |
| MARC1-0331 | 22 mer Anti-sense Strand | UUUGAUCACAAGCCAAAACCGG | 1577 |
| MARC1-0735 | 22 mer Anti-sense Strand | UUAACUUUCUUCUCUAGCCUGG | 1578 |
| MARC1-0736 | 22 mer Anti-sense Strand | UUUAACUUUCUUCUCUAGCCGG | 1579 |
| MARC1-0788 | 22 mer Anti-sense Strand | UUGCAUAGACAUCGCAUCCUGG | 1580 |
| MARC1-0863 | 22 mer Anti-sense Strand | UUAAAAUGCAUCUGGAACAAGG | 1581 |
| MARC1-1179 | 22 mer Anti-sense Strand | UAAAAUGUGAAAAUCACAAAGG | 1582 |
| MARC1-2012 | 22 mer Anti-sense Strand | UUUCCAUUUAUUCACAGUUUGG | 1583 |
| MARC1-2013 | 22 mer Anti-sense Strand | UCUUCCAUUUAUUCACAGUUGG | 1584 |
| MARC1-0661 | 22 mer Anti-sense Strand | UGAGUAAGCAAUCUGGUCCUGG | 1585 |
| MARC1-1869 | 22 mer Anti-sense Strand | UACAACUGACAUAUGCUUUCGG | 1586 |
| MARC1-1876 | 22 mer Anti-sense Strand | UGUUUUAAACAACUGACAUAGG | 1587 |
| MARC1-1886 | 22 mer Anti-sense Strand | UUAGAUAUUGGGUUUUAAACGG | 1588 |
| MARC1-2016 | 22 mer Anti-sense Strand | UUAGCUUCCAUUUAUUCACAGG | 1589 |
| MARC1-0413 | 22 mer Anti-sense Strand | UAGUCAGGGUGUCACCAUCGGG | 1590 |
| MARC1-0416 | 22 mer Anti-sense Strand | UGAGAGUCAGGGUGUCACCAGG | 1591 |
| MARC1-0622 | 22 mer Anti-sense Strand | UAUUUGAUGAGGACGUCUCGGG | 1592 |
| MARC1-0638 | 22 mer Anti-sense Strand | UUCGGAACAAGUCUGCUAUUGG | 1593 |
| MARC1-0657 | 22 mer Anti-sense Strand | UAAGCAAUCGGUCCUUGGGGG | 1594 |
| MARC1-0660 | 22 mer Anti-sense Strand | UAGUAAGCAAUCUGGUCCUUGG | 1595 |
| MARC1-0965 | 22 mer Anti-sense Strand | UUCCAUAUAACUUUCGUUCUGG | 1596 |
| MARC1-0966 | 22 mer Anti-sense Strand | UUUCCAUAUAACUUUCGUUCGG | 1597 |
| MARC1-0967 | 22 mer Anti-sense Strand | UUUUCCAUAUAACUUUCGUUGG | 1598 |

SEQUENCE LISTING

| Name | Strand | Sequence | SEQ ID NO |
|---|---|---|---|
| MARC1-0969 | 22 mer Anti-sense Strand | UAUUUUCCAUAUAACUUUCGGG | 1599 |
| MARC1-1177 | 22 mer Anti-sense Strand | UAAUGUGAAAAUCACAAAUUGG | 1600 |
| MARC1-1884 | 22 mer Anti-sense Strand | UGAUAUUGGGUUUUAAACAAGG | 1601 |
| MARC1-1885 | 22 mer Anti-sense Strand | UAGAUAUUGGGUUUUAAACAGG | 1602 |
| MARC1-1955 | 22 mer Anti-sense Strand | UAUCAAAGGACAAAAUGGCAGG | 1603 |
| MARC1-1983 | 22 mer Anti-sense Strand | UUUUCAAGUUUAGUCAACUUGG | 1604 |
| MARC1-1986 | 22 mer Anti-sense Strand | UAUUUUCAAGUUUAGUCAAGG | 1605 |
| MARC1-2011 | 22 mer Anti-sense Strand | UUCCAUUUAUUCACAGUUUUGG | 1606 |
| MARC1-1113 | 22 mer Anti-sense Strand | UUCCAUAUAGUGCUUGCUCGGG | 1607 |
| MARC1-1575 | 22 mer Anti-sense Strand | UAACAUUCUGGAACAUUCUUGG | 1608 |
| MARC1-0324 | 36 mer Sense Strand | [mCs][mG][mG][mA][mC][mA][fG][fG][fU][fU][mU][mU][mG][mG][mC][mU][mU][mG][mA][mG][mC][mA][mG][mC][mC][mG][ademA-GalNAc][ademA-GalNAc][ademA-GalNAc][mG][mG][mC][mU][mG][mC] | 1609 |
| MARC1-0326 | 36 mer Sense Strand | [mGs][mG][mA][mC][mA][mG][mG][fU][fU][fU][fU][mG][mG][mC][mU][mU][mG][mU][mG][mA][mA][mG][mC][mC][mG][ademA-GalNAc][ademA-GalNAc][ademA-GalNAc][mG][mG][mC][mU][mG][mC] | 1610 |
| MARC1-0327 | 36 mer Sense Strand | [mGs][mA][mC][mA][mG][mG][mU][fU][fU][fU][fG][mG][mC][mU][mU][mG][mU][mG][mA][mA][mG][mC][mA][mG][mC][mC][mG][ademA-GalNAc][ademA-GalNAc][ademA-GalNAc][mG][mG][mC][mU][mG][mC] | 1611 |
| MARC1-0330 | 36 mer Sense Strand | [mAs][mG][mG][mU][mU][mU][mU][fG][fG][fC][fU][mU][mG][mU][mG][mA][mU][mC][mA][mA][mG][mC][mA][mG][mC][mC][mG][ademA-GalNAc][ademA-GalNAc][ademA-GalNAc][mG][mG][mC][mU][mG][mC] | 1612 |
| MARC1-0331 | 36 mer Sense Strand | [mGs][mG][mU][mU][mU][mU][mG][fG][fC][fU][fU][mG][mU][mG][mA][mU][mC][mA][mA][mG][mC][mA][mG][mC][mC][mG][ademA-GalNAc][ademA-GalNAc][ademA-GalNAc][mG][mG][mC][mU][mG][mC] | 1613 |
| MARC1-0735 | 36 mer Sense Strand | [mAs][mG][mG][mC][mU][mA][mG][fA][fG][fA][fA][mG][mA][mA][mA][mG][mU][mU][mA][mA][mG][mC][mA][mG][mC][mC][mG][ademA-GalNAc][ademA-GalNAc][ademA-GalNAc][mG][mG][mC][mU][mG][mC] | 1614 |
| MARC1-0736 | 36 mer Sense Strand | [mGs][mG][mC][mU][mA][mG][mA][fG][fA][fA][fG][mA][mA][mA][mG][mU][mU][mA][mA][mG][mC][mA][mG][mC][mC][mG][ademA-GalNAc][ademA-GalNAc][ademA-GalNAc][mG][mG][mC][mU][mG][mC] | 1615 |

-continued

SEQUENCE LISTING

| Name | Strand | Sequence | SEQ ID NO |
|---|---|---|---|
| MARC1-0788 | 36 mer Sense Strand | [mAs][mG][mG][mA][mU][mG][mC][fG][fA][fU][fG][mU][mU][mA][mU][mG][mC][mA][mA][mG][mC][mA][mG][mC][mC][mG][ademA-GalNAc][ademA-GalNAc][ademA-GalNAc][mG][mG][mC][mU][mG][mC] | 1616 |
| MARC1-0863 | 36 mer Sense Strand | [mUs][mU][mG][mU][mU][mC][mC][fA][fG][fA][fU][mG][mC][mA][mU][mU][mU][mU][mA][mA][mG][mC][mA][mG][mC][mC][mG][ademA-GalNAc][ademA-GalNAc][ademA-GalNAc][mG][mG][mC][mU][mG][mC] | 1617 |
| MARC1-1179 | 36 mer Sense Strand | [mUs][mU][mU][mG][mU][mG][mA][fU][fU][fU][fU][mC][mA][mC][mA][mU][mU][mU][mA][mA][mA][mG][mC][mA][mG][mC][mC][mG][ademA-GalNAc][ademA-GalNAc][ademA-GalNAc][mG][mG][mC][mU][mG][mC] | 1618 |
| MARC1-2012 | 36 mer Sense Strand | [mAs][mA][mA][mC][mU][mG][mU][fG][fA][fA][fU][mA][mA][mA][mU][mG][mG][mA][mA][mA][mG][mC][mA][mG][mC][mC][mG][ademA-GalNAc][ademA-GalNAc][ademA-GalNAc][mG][mG][mC][mU][mG][mC] | 1619 |
| MARC1-2013 | 36 mer Sense Strand | [mAs][mA][mC][mU][mG][mU][mG][fA][fA][fU][fA][mA][mA][mU][mG][mG][mA][mA][mG][mA][mG][mC][mA][mG][mC][mC][mG][ademA-GalNAc][ademA-GalNAc][ademA-GalNAc][mG][mG][mC][mU][mG][mC] | 1620 |
| MARC1-0661 | 36 mer Sense Strand | [mAs][mG][mG][mA][mC][mC][mA][fG][fA][fU][fU][mG][mC][mU][mU][mU][mA][mC][mU][mC][mU][mC][mA][mC][mA][mG][mC][mC][mG][ademA-GalNAc][ademA-GalNAc][ademA-GalNAc][mG][mG][mC][mU][mG][mC] | 1621 |
| MARC1-1869 | 36 mer Sense Strand | [mGs][mA][mA][mA][mG][mC][mA][fU][fA][fU][fG][mU][mC][mA][mG][mU][mU][mG][mU][mA][mG][mC][mA][mG][mC][mC][mG][ademA-GalNAc][ademA-GalNAc][ademA-GalNAc][mG][mG][mC][mU][mG][mC] | 1622 |
| MARC1-1876 | 36 mer Sense Strand | [mUs][mA][mU][mG][mU][mC][mA][fG][fU][fU][fG][mU][mU][mU][mA][mA][mA][mA][mC][mA][mG][mC][mA][mG][mC][mC][mG][ademA-GalNAc][ademA-GalNAc][ademA-GalNAc][mG][mG][mC][mU][mG][mC] | 1623 |
| MARC1-1886 | 36 mer Sense Strand | [mGs][mU][mU][mU][mA][mA][mA][fA][fC][fC][fC][mA][mA][mU][mU][mA][mU][mC][mU][mA][mA][mG][mC][mA][mG][mC][mC][mG][ademA-GalNAc][ademA-GalNAc][ademA-GalNAc][mG][mG][mC][mU][mG][mC] | 1624 |
| MARC1-2016 | 36 mer Sense Strand | [mUs][mG][mU][mG][mA][mA][mU][fA][fA][fA][fU][mG][mG][mA][mA][mG][mC][mU][mA][mA][mG][mA][mG][mC][mA][mG][mC][mC][mG][ademA-GalNAc][ademA-GalNAc][ademA-GalNAc][mG][mG][mC][mU][mG][mC] | 1625 |

SEQUENCE LISTING

| Name | Strand | Sequence | SEQ ID NO |
|---|---|---|---|
| MARC1-0413 | 36 mer Sense Strand | [mCs][mG][mA][mU][mG][mG][mU][fG]<br>[fA][fC][fA][mC][mC][mC][mU][mG]<br>[mA][mC][mU][mA][mG][mC][mA][mG]<br>[mC][mC][mG][ademA-GalNAc][ademA-<br>GalNAc][ademA-<br>GalNAc][mG][mG][mC][mU][mG][mC] | 1626 |
| MARC1-0416 | 36 mer Sense Strand | [mUs][mG][mG][mU][mG][mA][mC][fA]<br>[fC][fC][fC][mU][mG][mA][mC][mU]<br>[mC][mU][mC][mA][mG][mC][mA][mG]<br>[mC][mC][mG][ademA-GalNAc][ademA-<br>GalNAc][ademA-<br>GalNAc][mG][mG][mC][mU][mG][mC] | 1627 |
| MARC1-0622 | 36 mer Sense Strand | [mCs][mG][mA][mG][mA][mC][mG][fU]<br>[fC][fC][fU][mC][mA][mU][mC][mA]<br>[mA][mA][mU][mA][mG][mC][mA][mG]<br>[mC][mC][mG][ademA-GalNAc][ademA-<br>GalNAc][ademA-<br>GalNAc][mG][mG][mC][mU][mG][mC] | 1628 |
| MARC1-0638 | 36 mer Sense Strand | [mAs][mA][mU][mA][mG][mC][mA][fG]<br>[fA][fC][fU][mU][mG][mU][mU][mC]<br>[mC][mG][mA][mA][mG][mC][mA][mG]<br>[mC][mC][mG][ademA-GalNAc][ademA-<br>GalNAc][ademA-<br>GalNAc][mG][mG][mC][mU][mG][mC] | 1629 |
| MARC1-0657 | 36 mer Sense Strand | [mCs][mC][mC][mA][mA][mG][mG][fA]<br>[fC][fC][fA][mG][mA][mU][mU][mG]<br>[mC][mU][mU][mA][mG][mC][mA][mG]<br>[mC][mC][mG][ademA-GalNAc][ademA-<br>GalNAc][ademA-<br>GalNAc][mG][mG][mC][mU][mG][mC] | 1630 |
| MARC1-0660 | 36 mer Sense Strand | [mAs][mA][mG][mG][mA][mC][mC][fA]<br>[fG][fA][fU][mU][mG][mC][mU][mU]<br>[mA][mC][mU][mA][mG][mC][mA][mG]<br>[mC][mC][mG][ademA-GalNAc][ademA-<br>GalNAc][ademA-<br>GalNAc][mG][mG][mC][mU][mG][mC] | 1631 |
| MARC1-0965 | 36 mer Sense Strand | [mAs][mG][mA][mA][mC][mG][mA][fA]<br>[fA][fG][fU][mU][mA][mU][mA][mU]<br>[mG][mG][mA][mA][mG][mC][mA][mG]<br>[mC][mC][mG][ademA-GalNAc][ademA-<br>GalNAc][ademA-<br>GalNAc][mG][mG][mC][mU][mG][mC] | 1632 |
| MARC1-0966 | 36 mer Sense Strand | [mGs][mA][mA][mC][mG][mA][mA][fA]<br>[fG][fU][fU][mA][mU][mA][mU][mG]<br>[mG][mA][mA][mA][mG][mC][mA][mG]<br>[mC][mC][mG][ademA-GalNAc][ademA-<br>GalNAc][ademA-<br>GalNAc][mG][mG][mC][mU][mG][mC] | 1633 |
| MARC1-0967 | 36 mer Sense Strand | [mAs][mA][mC][mG][mA][mA][mA][fG]<br>[fU][fU][fA][mU][mA][mU][mG][mG]<br>[mA][mA][mA][mA][mG][mC][mA][mG]<br>[mC][mC][mG][ademA-GalNAc][ademA-<br>GalNAc][ademA-<br>GalNAc][mG][mG][mC][mU][mG][mC] | 1634 |
| MARC1-0969 | 36 mer Sense Strand | [mCs][mG][mA][mA][mA][mG][mU][fU]<br>[fA][fU][fA][mU][mG][mG][mA][mA]<br>[mA][mA][mU][mA][mG][mC][mA][mG]<br>[mC][mC][mG][ademA-GalNAc][ademA-<br>GalNAc][ademA-<br>GalNAc][mG][mG][mC][mU][mG][mC] | 1635 |

SEQUENCE LISTING

| Name | Strand | Sequence | SEQ ID NO |
|---|---|---|---|
| MARC1-1177 | 36 mer Sense Strand | [mAs][mA][mU][mU][mU][mG][mU][fG][fA][fU][fU][mU][mC][mA][mC][mA][mU][mU][mA][mG][mC][mA][mG][mC][mC][mG][ademA-GalNAc][ademA-GalNAc][ademA-GalNAc][mG][mG][mC][mU][mG][mC] | 1636 |
| MARC1-1884 | 36 mer Sense Strand | [mUs][mU][mG][mU][mU][mU][mA][fA][fA][fA][fC][mC][mC][mA][mA][mU][mA][mU][mC][mA][mG][mC][mA][mG][mC][mC][mG][ademA-GalNAc][ademA-GalNAc][ademA-GalNAc][mG][mG][mC][mU][mG][mC] | 1637 |
| MARC1-1885 | 36 mer Sense Strand | [mUs][mG][mU][mU][mA][mA][fA][fA][fC][fC][mC][mA][mA][mU][mA][mU][mC][mU][mA][mG][mC][mA][mG][mC][mC][mG][ademA-GalNAc][ademA-GalNAc][ademA-GalNAc][mG][mG][mC][mU][mG][mC] | 1638 |
| MARC1-1955 | 36 mer Sense Strand | [mUs][mG][mC][mC][mA][mU][mU][fU][fU][fG][fU][mC][mC][mU][mU][mU][mG][mA][mU][mA][mG][mC][mA][mG][mC][mC][mG][ademA-GalNAc][ademA-GalNAc][ademA-GalNAc][mG][mG][mC][mU][mG][mC] | 1639 |
| MARC1-1983 | 36 mer Sense Strand | [mAs][mA][mG][mU][mU][mG][mA][fC][fU][fA][fA][mA][mC][mU][mU][mG][mA][mA][mA][mG][mC][mA][mG][mC][mC][mG][ademA-GalNAc][ademA-GalNAc][ademA-GalNAc][mG][mG][mC][mU][mG][mC] | 1640 |
| MARC1-1986 | 36 mer Sense Strand | [mUs][mU][mG][mA][mC][mU][mA][fA][fA][fC][fU][mU][mG][mA][mA][mA][mA][mA][mU][mA][mG][mC][mA][mG][mC][mC][mG][ademA-GalNAc][ademA-GalNAc][ademA-GalNAc][mG][mG][mC][mU][mG][mC] | 1641 |
| MARC1-2011 | 36 mer Sense Strand | [mAs][mA][mA][mA][mC][mU][mG][fU][fG][fA][fA][mU][mA][mA][mA][mU][mG][mG][mA][mA][mG][mC][mA][mG][mC][mC][mG][ademA-GalNAc][ademA-GalNAc][ademA-GalNAc][mG][mG][mC][mU][mG][mC] | 1642 |
| MARC1-1113 | 36 mer Sense Strand | [mCs][mG][mA][mG][mC][mA][mA][fG][fC][fA][fC][mU][mA][mU][mA][mU][mG][mG][mA][mA][mG][mC][mA][mG][mC][mC][mG][ademA-GalNAc][ademA-GalNAc][ademA-GalNAc][mG][mG][mC][mU][mG][mC] | 1643 |
| MARC1-1575 | 36 mer Sense Strand | [mAs][mA][mG][mA][mA][mU][mG][fU][fU][fC][fC][mA][mG][mA][mA][mU][mG][mU][mU][mA][mG][mC][mA][mG][mC][mC][mG][ademA-GalNAc][ademA-GalNAc][ademA-GalNAc][mG][mG][mC][mU][mG][mC] | 1644 |
| MARC1-0324 | 22 mer Anti-sense Strand | [MePhosphonate-40-mUs][fCs][fAs][fA][fG][mC][fC][mA][mA][fA][mA][mC][mC][fU][mG][mU][mC][mC][mC][mGs][mGs][mG] | 1645 |
| MARC1-0326 | 22 mer Anti-sense Strand | [MePhosphonate-40-mUs][fCs][fAs][fC][fA][mA][fG][mC][mC][fA][mA][mA][mA][fC][mC][mU][mG][mU][mC][mCs][mGs][mG] | 1646 |

SEQUENCE LISTING

| Name | Strand | Sequence | SEQ ID NO |
|---|---|---|---|
| MARC1-0327 | 22 mer Anti-sense Strand | [MePhosphonate-4O-mUs][fUs][fCs][fA][fC][mA][fA][mG][mC][fC][mA][mA][mA][fA][mC][mC][mU][mG][mU][mCs][mGs][mG] | 1647 |
| MARC1-0330 | 22 mer Anti-sense Strand | [MePhosphonate-4O-mUs][fUs][fGs][fA][fU][mC][fA][mC][mA][fA][mG][mC][mC][fA][mA][mA][mA][mC][mC][mUs][mGs][mG] | 1648 |
| MARC1-0331 | 22 mer Anti-sense Strand | [MePhosphonate-4O-mUs][fUs][fUs][fG][fA][mU][fC][mA][mC][fA][mA][mG][mC][fC][mA][mA][mA][mA][mC][mCs][mGs][mG] | 1649 |
| MARC1-0735 | 22 mer Anti-sense Strand | [MePhosphonate-4O-mUs][fUs][fAs][fA][fC][mU][fU][mU][mC][fU][mU][mC][mU][fC][mU][mA][mG][mC][mC][mUs][mGs][mG] | 1650 |
| MARC1-0736 | 22 mer Anti-sense Strand | [MePhosphonate-4O-mUs][fUs][fUs][fA][fA][mC][fU][mU][mU][fC][mU][mU][mC][fU][mC][mU][mA][mG][mC][mCs][mGs][mG] | 1651 |
| MARC1-0788 | 22 mer Anti-sense Strand | [MePhosphonate-4O-mUs][fUs][fGs][fC][fA][mU][fA][mG][mA][fC][mA][mU][mC][fG][mC][mA][mU][mC][mC][mUs][mGs][mG] | 1652 |
| MARC1-0863 | 22 mer Anti-sense Strand | [MePhosphonate-4O-mUs][fUs][fAs][fA][fA][mA][fU][mG][mC][fA][mU][mC][mU][fG][mG][mA][mA][mC][mA][mAs][mGs][mG] | 1653 |
| MARC1-1179 | 22 mer Anti-sense Strand | [MePhosphonate-4O-mUs][fAs][fAs][fA][fA][mU][fG][mU][mG][fA][mA][mA][mA][fU][mC][mA][mC][mA][mA][mAs][mGs][mG] | 1654 |
| MARC1-2012 | 22 mer Anti-sense Strand | [MePhosphonate-4O-mUs][fUs][fUs][fC][fC][mA][fU][mU][mU][fA][mU][mU][mC][fA][mC][mA][mG][mU][mU][mUs][mGs][mG] | 1655 |
| MARC1-2013 | 22 mer Anti-sense Strand | [MePhosphonate-4O-mUs][fCs][fUs][fU][fC][mC][fA][mU][mU][fU][mA][mU][mU][fC][mA][mC][mA][mG][mU][mUs][mGs][mG] | 1656 |
| MARC1-0661 | 22 mer Anti-sense Strand | [MePhosphonate-4O-mUs][fGs][fAs][fG][fU][mA][fA][mG][mC][fA][mA][mU][mC][fU][mG][mG][mU][mC][mC][mUs][mGs][mG] | 1657 |
| MARC1-1869 | 22 mer Anti-sense Strand | [MePhosphonate-4O-mUs][fAs][fCs][fA][fA][mC][fU][mG][mA][fC][mA][mU][mA][fU][mG][mC][mU][mU][mU][mCs][mGs][mG] | 1658 |
| MARC1-1876 | 22 mer Anti-sense Strand | [MePhosphonate-4O-mUs][fGs][fUs][fU][fU][mU][fA][mA][mA][fC][mA][mA][mC][fU][mG][mA][mC][mA][mU][mAs][mGs][mG] | 1659 |
| MARC1-1886 | 22 mer Anti-sense Strand | [MePhosphonate-4O-mUs][fUs][fAs][fG][fA][mU][fA][mU][mU][fG][mG][mG][mU][fU][mU][mU][mA][mA][mA][mCs][mGs][mG] | 1660 |

SEQUENCE LISTING

| Name | Strand | Sequence | SEQ ID NO |
|---|---|---|---|
| MARC1-2016 | 22 mer Anti-sense Strand | [MePhosphonate-4O-mUs][fUs][fAs][fG][fC][mU][fU][mC][mC][fA][mU][mU][mU][fA][mU][mU][mC][mA][mC][mAs][mGs][mG] | 1661 |
| MARC1-0413 | 22 mer Anti-sense Strand | [MePhosphonate-4O-mUs][fAs][fGs][fU][fC][mA][fG][mG][mG][fU][mG][mU][mC][fA][mC][mC][mA][mU][mC][mGs][mGs][mG] | 1662 |
| MARC1-0416 | 22 mer Anti-sense Strand | [MePhosphonate-4O-mUs][fGs][fAs][fG][fA][mG][fU][mC][mA][fG][mG][mG][mU][fG][mU][mC][mA][mC][mC][mAs][mGs][mG] | 1663 |
| MARC1-0622 | 22 mer Anti-sense Strand | [MePhosphonate-4O-mUs][fAs][fUs][fU][fU][mG][fA][mU][mG][fA][mG][mG][mA][fC][mG][mU][mC][mU][mC][mGs][mGs][mG] | 1664 |
| MARC1-0638 | 22 mer Anti-sense Strand | [MePhosphonate-4O-mUs][fUs][fCs][fG][fG][mA][fA][mC][mA][fA][mG][mU][mC][fU][mG][mC][mU][mA][mU][mUs][mGs][mG] | 1665 |
| MARC1-0657 | 22 mer Anti-sense Strand | [MePhosphonate-4O-mUs][fAs][fAs][fG][fC][mA][fA][mU][mC][fU][mG][mU][mU][fC][mC][mU][mU][mG][mG][mGs][mGs][mG] | 1666 |
| MARC1-0660 | 22 mer Anti-sense Strand | [MePhosphonate-4O-mUs][fAs][fGs][fU][fA][mA][fG][mC][mA][fA][mU][mC][mU][fG][mG][mU][mC][mC][mU][mUs][mGs][mG] | 1667 |
| MARC1-0965 | 22 mer Anti-sense Strand | [MePhosphonate-4O-mUs][fUs][fCs][fC][fA][mU][fA][mU][mA][fA][mC][mU][mU][fU][mC][mG][mU][mU][mC][mUs][mGs][mG] | 1668 |
| MARC1-0966 | 22 mer Anti-sense Strand | [MePhosphonate-4O-mUs][fUs][fUs][fC][fC][mA][fU][mA][mU][fA][mA][mC][mU][fU][mU][mC][mG][mU][mU][mCs][mGs][mG] | 1669 |
| MARC1-0967 | 22 mer Anti-sense Strand | [MePhosphonate-4O-mUs][fUs][fUs][fU][fC][mC][fA][mU][mA][fU][mA][mA][mC][fU][mU][mU][mC][mG][mU][mUs][mGs][mG] | 1670 |
| MARC1-0969 | 22 mer Anti-sense Strand | [MePhosphonate-4O-mUs][fAs][fUs][fU][fU][mU][fC][mC][mA][fU][mA][mU][mA][fA][mC][mU][mU][mU][mC][mGs][mGs][mG] | 1671 |
| MARC1-1177 | 22 mer Anti-sense Strand | [MePhosphonate-4O-mUs][fAs][fAs][fU][fG][mU][fG][mA][mA][fA][mA][mU][mC][fA][mC][mA][mA][mA][mU][mUs][mGs][mG] | 1672 |
| MARC1-1884 | 22 mer Anti-sense Strand | [MePhosphonate-4O-mUs][fGs][fAs][fU][fA][mU][fU][mG][mG][fG][mU][mU][mU][fU][mA][mA][mA][mC][mA][mAs][mGs][mG] | 1673 |
| MARC1-1885 | 22 mer Anti-sense Strand | [MePhosphonate-4O-mUs][fAs][fGs][fA][fU][mA][fU][mU][mG][fG][mG][mU][mU][fU][mU][mA][mA][mA][mC][mAs][mGs][mG] | 1674 |

SEQUENCE LISTING

| Name | Strand | Sequence | SEQ ID NO |
|---|---|---|---|
| MARC1-1955 | 22 mer Anti-sense Strand | [MePhosphonate-40-mUs][fAs][fUs][fC][fA][mA][fA][mG][mG][fA][mC][mA][mA][fA][mA][mU][mG][mG][mC][mAs][mGs][mG] | 1675 |
| MARC1-1983 | 22 mer Anti-sense Strand | [MePhosphonate-40-mUs][fUs][fUs][fU][fC][mA][fA][mG][mU][fU][mU][mA][mG][fU][mC][mA][mA][mC][mU][mUs][mGs][mG] | 1676 |
| MARC1-1986 | 22 mer Anti-sense Strand | [MePhosphonate-40-mUs][fAs][fUs][fU][fU][mU][fU][mC][mA][fA][mG][mU][mU][fU][mA][mG][mU][mC][mA][mAs][mGs][mG] | 1677 |
| MARC1-2011 | 22 mer Anti-sense Strand | [MePhosphonate-40-mUs][fUs][fCs][fC][fA][mU][fU][mU][mA][fU][mU][mC][mA][fC][mA][mG][mU][mU][mU][mUs][mGs][mG] | 1678 |
| MARC1-1113 | 22 mer Anti-sense Strand | [MePhosphonate-40-mUs][fUs][fC][fC][fA][mU][fA][mU][mA][fG][mU][mG][mC][fU][mU][mG][mC][mU][mC][mGs][mGs][mG] | 1679 |
| MARC1-1575 | 22 mer Anti-sense Strand | [MePhosphonate-40-mUs][fAs][fA][fC][fA][mU][fU][mC][mU][fG][mG][mA][mA][fC][mA][mU][mU][mC][mU][mUs][mGs][mG] | 1680 |
| Stem Loop | | GCAGCCGAAAGGCUGC | 1681 |
| MARC1 cDNA plasmid | | GACGGATCGGGAGATCTCCCGATCC CCTATGGTCGACTCTCAGTACAATC TGCTCTGATGCCGCATAGTTAAGCC AGTATCTGCTCCCTGCTTGTGTGTTG GAGGTCGCTGAGTAGTGCGCGAGCA AAATTTAAGCTACAACAAGGCAAGG CTTGACCGACAATTGCATGAAGAAT CTGCTTAGGGTTAGGCGTTTTGCGCT GCTTCGCGATGTACGGGCCAGATAT ACGCGTTGACATTGATTATTGACTA GTTATTAATAGTAATCAATTACGGG GTCATTAGTTCATAGCCCATATATG GAGTTCCGCGTTACATAACTTACGG TAAATGGCCCGCCTGGCTGACCGCC CAACGACCCCCGCCCATTGACGTCA ATAATGACGTATGTTCCCATAGTAA CGCCAATAGGGACTTTCCATTGACG TCAATGGGTGGAGTATTTACGGTAA ACTGCCCACTTGGCAGTACATCAAG TGTATCATATGCCAAGTACGCCCCC TATTGACGTCAATGACGGTAAATGG CCCGCCTGGCATTATGCCCAGTACA TGACCTTATGGGACTTTCCTACTTGG CAGTACATCTACGTATTAGTCATCG CTATTACCATGGTGATGCGGTTTTG GCAGTACATCAATGGGCGTGGATAG CGGTTTGACTCACGGGGATTTCCAA GTCTCCACCCCATTGACGTCAATGG GAGTTTGTTTTGGCACCAAAATCAA CGGGACTTTCCAAAATGTCGTAACA ACTCCGCCCCATTGACGCAAATGGG CGGTAGGCGTGTACGGTGGGAGGTC TATATAAGCAGAGCTCTCTGGCTAA CTAGAGAACCCACTGCTTACTGGCT TATCGAAATTAATACGACTCACTAT AGGGAGACCCAAGCTGGCTAGCGTT TAAACTTAAGCTTACAGCGCCCTGC AGCGCAGGCGACGGAAGGTTGCAG AGGCAGTGGGCGCCGACCAAGTG GAAGCTGAGCCACCACCTCCCACTC | 1682 |

| Name | Strand | Sequence | SEQ ID NO |
|---|---|---|---|
| | | CCCGCGCCGCCCCCCAGAAGGACGC | |
| | | ACTGCTCTGATTGGCCCGGAAGGGT | |
| | | TCAGGAGCTGCCCAGCCTTTGGGCT | |
| | | CGGGGCCAAAGGCCGCACCTTCCCC | |
| | | CAGCGGCCCCGGGCGACCAGCGCGC | |
| | | TCCGGCCTTGCCGCCGCCACCTCGC | |
| | | GGAGAAGCCAGCCATGGGCGCCGC | |
| | | CGGCTCCTCCGCGCTGGCGCGCTTT | |
| | | GTCCTCCTCGCGCAATCCCGGCCCG | |
| | | GGTGGCTCGGGGTTGCCGCGCTGGG | |
| | | CCTGACCGCGGTGGCGCTGGGGGCT | |
| | | GTCGCCTGGCGCCGCGCATGGCCCA | |
| | | CGCGGCGCCGGCGGCTGCTGCAGCA | |
| | | GGTGGGCACAGTGGCGCAGCTCTGG | |
| | | ATCTACCCTGTGAAATCCTGCAAGG | |
| | | GGGTGCCGGTGAGCGAGGCGGAGT | |
| | | GCACGGCCATGGGGCTGCGCAGCGG | |
| | | CAACCTGCGGGACAGGTTTTGGCTT | |
| | | GTGATCAACCAGGAGGGAAACATG | |
| | | GTTACTGCTCGCCAGGAACCTCGCC | |
| | | TGGTCCTGATTTCCCTGACCTGCGAT | |
| | | GGTGACACCCTGACTCTCAGTGCAG | |
| | | CCTACACAAAGGACCTACTACTGCC | |
| | | TATCAAAACGCCCACCACAAATGCA | |
| | | GTGCACAAGTGCAGAGTGCACGGCC | |
| | | TGGAGATAGAGGGCAGGGACTGTG | |
| | | GCGAGGCCACCGCCCAGTGGATAAC | |
| | | CAGCTTCCTGAAGTCACAGCCCTAC | |
| | | CGCCTGGTGCACTTCGAGCCTCACA | |
| | | TGCGACCGAGACGTCCTCATCAAAT | |
| | | AGCAGACTTGTTCCGACCCAAGGAC | |
| | | CAGATTGCTTACTCAGACACCAGCC | |
| | | CATTCTTGATCCTTTCTGAGGCGTCG | |
| | | CTGGCGGATCTCAACTCCAGGCTAG | |
| | | AGAAGAAAGTTAAAGCAACCAACTT | |
| | | CAGGCCCAATATTGTAATTTCAGGA | |
| | | TGCGATGTCTATGCAGAGGTAACAC | |
| | | TATGCCCCTTTGGATCTTTCCTTGGA | |
| | | TTTGACTTCTTTTTTAAGGATTCTTG | |
| | | GGATGAGCTTCTTATTGGTGACGTG | |
| | | GAACTGAAAAGGGTGATGGCTTGTT | |
| | | CCAGATGCATTTTAACCACAGTGGA | |
| | | CCCAGACACCGGTGTCATGAGCAGG | |
| | | AAGGAACCGCTGGAAACACTGAAG | |
| | | AGTTATCGCCAGTGTGACCCTTCAG | |
| | | AACGAAAGTTATATGGAAAATCACC | |
| | | ACTCTTTGGGCAGTATTTTGTGCTGG | |
| | | AAAACCCAGGGACCATCAAAGTGG | |
| | | GAGACCCTGTGTACCTGCTGGGCCA | |
| | | GTAATGGGAACCGTATGTCCTGGAA | |
| | | TATTAGATGCCTTTTAAAAATGTTCT | |
| | | CAAAAATGACAACACTTGAAGCATG | |
| | | GTGTTTCAGAACTGAGACCTCTACA | |
| | | TTTTCTTTAAATTTGTGATTTTCACA | |
| | | TTTTTCGTCTTTTGGACTTCTGGTGT | |
| | | CTCAATGCTTCAATGTCCCAGTGCA | |
| | | AAAAGTAAAGAAATATAGTCTCAAT | |
| | | AACTTAGTAGGACTTCAGTAAGTCA | |
| | | CTTAAATGACAAGACAGGATTCTGA | |
| | | AAACTCCCCGTTTAACTGATTATGG | |
| | | AATAGTTCTTTCTCCTGCTTCTCCGT | |
| | | TTATCTACCAAGAGCGCAGACTTGC | |
| | | ATCCTGTCACTACCACTCGTTAGAG | |
| | | AAAGAGAAGAAGAGAAAGAGGAAG | |
| | | AGTGGGTGGGCTGGAAGAATATCCT | |
| | | AGAATGTGTTATTGCCCCTGTTCATG | |
| | | AGGTACGCAATGAAAATTAAATTGC | |
| | | ACCCCAAATATGGCTGGAATGCCAC | |
| | | TTCCCTTTTCTTCTCAAGCCCCGGGC | |
| | | TAGCTTTTGAAATGGCATAAAGACT | |
| | | GAGGTGACCTTCAGGAAGCACTGCA | |
| | | GATATTAATTTTCCATAGATCTGGAT | |
| | | CTGGCCCTGCTGCTTCTCAGACAGC | |

SEQUENCE LISTING

| Name | Strand | Sequence | SEQ ID NO |
|---|---|---|---|
| | | ATTGGATTTCCTAAAGGTGCTCAGG | |
| | | AGGATGGTTGTGTAGTCATGGAGGA | |
| | | CCCCTGGATCCTTGCCATTCCCTCA | |
| | | GCTAATGACGGAGTGCTCCTTCTCC | |
| | | AGTTCCGGGTGAAAAGTTCTGAAT | |
| | | TCTGTGGAGGAGAAGAAAAGTGATT | |
| | | CAGTGATTTCAGATAGACTACTGAA | |
| | | AACCTTTAAAGGGGAAAAGGAAA | |
| | | GCATATGTCAGTTGTTTAAAACCCA | |
| | | ATATCTATTTTTTAACTGATTGTATA | |
| | | ACTCTAAGATCTGATGAAGTATATT | |
| | | TTTTATTGCCATTTTGTCCTTTGATT | |
| | | ATATTGGAAGTTGACTAAACTTGA | |
| | | AAAATGTTTTTAAAACTGTGAATAA | |
| | | ATGGAAGCTACTTTGACTAGTTTCA | |
| | | GAGCGGCCGCTCGAGTCTAGAGGGC | |
| | | CCGTTTAAACCCGCTGATCAGCCTC | |
| | | GACTGTGCCTTCTAGTTGCCAGCCA | |
| | | TCTGTTGTTTGCCCCTCCCCCGTGCC | |
| | | TTCCTTGACCCTGGAAGGTGCCACT | |
| | | CCCACTGTCCTTTCCTAATAAAATG | |
| | | AGGAAATTGCATCGCATTGTCTGAG | |
| | | TAGGTGTCATTCTATTCTGGGGGGT | |
| | | GGGGTGGGGCAGGACAGCAAGGGG | |
| | | GAGGATTGGGAAGACAATAGCAGG | |
| | | CATGCTGGGGATGCGGTGGGCTCTA | |
| | | TGGCTTCTGAGGCGGAAAGAACCAG | |
| | | CTGGGGCTCTAGGGGGTATCCCCAC | |
| | | GCGCCCTGTAGCGGCGCATTAAGCG | |
| | | CGGCGGGTGTGGTGGTTACGCGCAG | |
| | | CGTGACCGCTACACTTGCCAGCGCC | |
| | | CTAGCGCCCGCTCCTTTCGCTTTCTT | |
| | | CCCTTCCTTTCTCGCCACGTTCGCCG | |
| | | GCTTTCCCCGTCAAGCTCTAAATCG | |
| | | GGGGCTCCCTTTAGGGTTCCGATTT | |
| | | AGTGCTTTACGGCACCTCGACCCCA | |
| | | AAAAACTTGATTAGGGTGATGGTTC | |
| | | ACGTAGTGGGCCATCGCCCTGATAG | |
| | | ACGGTTTTTCGCCCTTTGACGTTGGA | |
| | | GTCCACGTTCTTTAATAGTGGACTCT | |
| | | TGTTCCAAACTGGAACAACACTCAA | |
| | | CCCTATCTCGGTCTATTCTTTTGATT | |
| | | TATAAGGGATTTTGGGGATTTCGGC | |
| | | CTATTGGTTAAAAAATGAGCTGATT | |
| | | TAACAAAAATTTAACGCGAATTAAT | |
| | | TCTGTGGAATGTGTGTCAGTTAGGG | |
| | | TGTGGAAAGTCCCCAGGCTCCCCAG | |
| | | GCAGGCAGAAGTATGCAAAGCATG | |
| | | CATCTCAATTAGTCAGCAACCAGGT | |
| | | GTGGAAAGTCCCCAGGCTCCCCAGC | |
| | | AGGCAGAAGTATGCAAAGCATGCAT | |
| | | CTCAATTAGTCAGCAACCATAGTCC | |
| | | CGCCCCTAACTCCGCCCATCCCGCC | |
| | | CCTAACTCCGCCCAGTTCCGCCCATT | |
| | | CTCCGCCCCATGGCTGACTAATTTTT | |
| | | TTTATTTATGCAGAGGCCGAGGCCG | |
| | | CCTCTGCCTCTGAGCTATTCCAGAA | |
| | | GTAGTGAGGAGGCTTTTTTGGAGGC | |
| | | CTAGGCTTTTGCAAAAAGCTCCCGG | |
| | | GAGCTTGTATATCCATTTTCGGATCT | |
| | | GATCAAGAGACAGGATGAGGATCG | |
| | | TTTCGCATGATTGAACAAGATGGAT | |
| | | TGCACGCAGGTTCTCCGGCCGCTTG | |
| | | GGTGGAGAGGCTATTCGGCTATGAC | |
| | | TGGGCACAACAGACAATCGGCTGCT | |
| | | CTGATGCCGCCGTGTTCCGGCTGTC | |
| | | AGCGCAGGGGCGCCCGGTTCTTTTT | |
| | | GTCAAGACCGACCTGTCCGGTGCCC | |
| | | TGAATGAACTGCAGGACGAGGCAG | |
| | | CGCGGCTATCGTGGCTGGCCACGAC | |
| | | GGGCGTTCCTTGCGCAGCTGTGCTC | |
| | | GACGTTGTCACTGAAGCGGGAAGGG | |
| | | ACTGGCTGCTATTGGGCGAAGTGCC | |

SEQUENCE LISTING

| Name | Strand | Sequence | SEQ ID NO |
|------|--------|----------|-----------|
| | | GGGGCAGGATCTCCTGTCATCTCAC | |
| | | CTTGCTCCTGCCGAGAAAGTATCCA | |
| | | TCATGGCTGATGCAATGCGGCGGCT | |
| | | GCATACGCTTGATCCGGCTACCTGC | |
| | | CCATTCGACCACCAAGCGAAACATC | |
| | | GCATCGAGCGAGCACGTACTCGGAT | |
| | | GGAAGCCGGTCTTGTCGATCAGGAT | |
| | | GATCTGGACGAAGAGCATCAGGGG | |
| | | CTCGCGCCAGCCGAACTGTTCGCCA | |
| | | GGCTCAAGGCGCGCATGCCCGACGG | |
| | | CGAGGATCTCGTCGTGACCCATGGC | |
| | | GATGCCTGCTTGCCGAATATCATGG | |
| | | TGGAAAATGGCCGCTTTTCTGGATT | |
| | | CATCGACTGTGGCCGGCTGGGTGTG | |
| | | GCGGACCGCTATCAGGACATAGCGT | |
| | | TGGCTACCCGTGATATTGCTGAAGA | |
| | | GCTTGGCGGCGAATGGGCTGACCGC | |
| | | TTCCTCGTGCTTTACGGTATCGCCG | |
| | | TCCCGATTCGCAGCGCATCGCCTTCT | |
| | | ATCGCCTTCTTGACGAGTTCTTCTGA | |
| | | GCGGGACTCTGGGGTTCGAAATGAC | |
| | | CGACCAAGCGACGCCCAACCTGCCA | |
| | | TCACGAGATTTCGATTCCACCGCCG | |
| | | CCTTCTATGAAAGGTTGGGCTTCGG | |
| | | AATCGTTTTCCGGGACGCCGGCTGG | |
| | | ATGATCCTCCAGCGCGGGATCTCA | |
| | | TGCTGGAGTTCTTCGCCCACCCCAA | |
| | | CTTGTTTATTGCAGCTTATAATGGTT | |
| | | ACAAATAAAGCAATAGCATCACAA | |
| | | ATTTCACAAATAAAGCATTTTTTTCA | |
| | | CTGCATTCTAGTTGTGGTTTGTCCAA | |
| | | ACTCATCAATGTATCTTATCATGTCT | |
| | | GTATACCGTCGACCTCTAGCTAGAG | |
| | | CTTGGCGTAATCATGGTCATAGCTG | |
| | | TTTCCTGTGTGAAATTGTTATCCGCT | |
| | | CACAATTCCACACAACATACGAGCC | |
| | | GGAAGCATAAAGTGTAAAGCCTGG | |
| | | GGTGCCTAATGAGTGAGCTAACTCA | |
| | | CATTAATTGCGTTGCGCTCACTGCCC | |
| | | GCTTTCCAGTCGGGAAACCTGTCGT | |
| | | GCCAGCTGCATTAATGAATCGGCCA | |
| | | ACGCGCGGGGAGAGGCGGTTTGCGT | |
| | | ATTGGGCGCTCTTCCGCTTCCTCGCT | |
| | | CACTGACTCGCTGCGCTCGGTCGTT | |
| | | CGGCTGCGGCGAGCGGTATCAGCTC | |
| | | ACTCAAAGGCGGTAATACGGTTATC | |
| | | CACAGAATCAGGGGATAACGCAGG | |
| | | AAAGAACATGTGAGCAAAAGGCCA | |
| | | GCAAAAGGCCAGGAACCGTAAAAA | |
| | | GGCCGCGTTGCTGGCGTTTTTCCATA | |
| | | GGCTCCGCCCCCTGACGAGCATCA | |
| | | CAAAAATCGACGCTCAAGTCAGAGG | |
| | | TGGCGAAACCCGACAGGACTATAAA | |
| | | GATACCAGGCGTTTCCCCCTGGAAG | |
| | | CTCCCTCGTGCGCTCTCCTGTTCCGA | |
| | | CCCTGCCGCTTACCGGATACCTGTC | |
| | | CGCCTTTCTCCCTTCGGGAAGCGTG | |
| | | GCGCTTTCTCAATGCTCACGCTGTA | |
| | | GGTATCTCAGTTCGGTGTAGGTCGT | |
| | | TCGCTCCAAGCTGGGCTGTGTGCAC | |
| | | GAACCCCCCGTTCAGCCCGACCGCT | |
| | | GCGCCTTATCCGGTAACTATCGTCTT | |
| | | GAGTCCAACCCGGTAAGACACGACT | |
| | | TATCGCCACTGGCAGCAGCCACTGG | |
| | | TAACAGGATTAGCAGAGCGAGGTAT | |
| | | GTAGGCGGTGCTACAGAGTTCTTGA | |
| | | AGTGGTGGCCTAACTACGGCTACAC | |
| | | TAGAAGGACAGTATTTGGTATCTGC | |
| | | GCTCTGCTGAAGCCAGTTACCTTCG | |
| | | GAAAAAGAGTTGGTAGCTCTTGATC | |
| | | CGGCAAACAAACCACCGCTGGTAGC | |
| | | GGTGGTTTTTTTGTTTGCAAGCAGCA | |
| | | GATTACGCGCAGAAAAAAAGGATCT | |

| Name | Strand | Sequence | SEQ ID NO |
|---|---|---|---|
| | | CAAGAAGATCCTTTGATCTTTTCTAC GGGGTCTGACGCTCAGTGGAACGAA AACTCACGTTAAGGGATTTTGGTCA TGAGATTATCAAAAAGGATCTTCAC CTAGATCCTTTTAAATTAAAAATGA AGTTTTAAATCAATCTAAAGTATAT ATGAGTAAACTTGGTCTGACAGTTA CCAATGCTTAATCAGTGAGGCACCT ATCTCAGCGATCTGTCTATTTCGTTC ATCCATAGTTGCCTGACTCCCCGTC GTGTAGATAACTACGATACGGGAGG GCTTACCATCTGGCCCCAGTGCTGC AATGATACCGCGAGACCCACGCTCA CCGGCTCCAGATTTATCAGCAATAA ACCAGCCAGCCGGAAGGGCCGAGC GCAGAAGTGGTCCTGCAACTTTATC CGCCTCCATCCAGTCTATTAATTGTT GCCGGGAAGCTAGAGTAAGTAGTTC GCCAGTTAATAGTTTGCGCAACGTT GTTGCCATTGCTACAGGCATCGTGG TGTCACGCTCGTCGTTTGGTATGGCT TCATTCAGCTCCGGTTCCCAACGAT CAAGGCGAGTTACATGATCCCCCAT GTTGTGCAAAAAAGCGGTTAGCTCC TTCGGTCCTCCGATCGTTGTCAGAA GTAAGTTGGCCGCAGTGTTATCACT CATGGTTATGGCAGCACTGCATAAT TCTCTTACTGTCATGCCATCCGTAAG ATGCTTTTCTGTGACTGGTGAGTACT CAACCAAGTCATTCTGAGAATAGTG TATGCGGCGACCGAGTTGCTCTTGC CCGGCGTCAATACGGGATAATACCG CGCCACATAGCAGAACTTTAAAAGT GCTCATCATTGGAAAACGTTCTTCG GGGCGAAAACTCTCAAGGATCTTAC CGCTGTTGAGATCCAGTTCGATGTA ACCCACTCGTGCACCCAACTGATCT TCAGCATCTTTTACTTTCACCAGCGT TTCTGGGTGAGCAAAAACAGGAAG GCAAAATGCCGCAAAAAAGGGAAT AAGGGCGACACGGAAATGTTGAAT ACTCATACTCTTCCTTTTTCAATATT ATTGAAGCATTTATCAGGGTTATTG TCTCATGAGCGGATACATATTTGAA TGTATTTAGAAAAATAAACAAATAG GGGTTCCGCGCACATTTCCCCGAAA AGTGCCACCTGACGTC | |
| MARC1 cDNA (XM_011509900 .3) | | ACAGCGCCCTGCAGCGCAGGCGACG GAAGGTTGCAGAGGCAGTGGGGCG CCGACCAAGTGGAAGCTGAGCCACC ACCTCCCACTCCCCGCGCCGCCCCC CAGAAGGACGCACTGCTCTGATTGG CCCGGAAGGGTTCAGGAGCTGCCCA GCCTTTGGGCTCGGGGCCAAAGGCC GCACCTTCCCCCAGCGGCCCCGGGC GACCAGCGCGCTCCGGCCTTGCCGC CGCCACCTCGCGGAGAAGCCAGCCA TGGGCGCCGCCGGCTCCTCCGCGCT GGCGCGCTTTGTCCTCCTCGCGCAA TCCCGGCCCGGGTGGCTCGGGGTTG CCGCGCTGGGCCTGACCGCGGTGGC GCTGGGGGCTGTCGCCTGGCGCCGC GCATGGCCCACGCGGCGCCGGCGGC TGCTGCAGCAGGTGGGCACAGTGGC GCAGCTCTGGATCTACCCTGTGAAA TCCTGCAAGGGGGTGCCGGTGAGCG AGGCGGAGTGCACGGCCATGGGGCT GCGCAGCGGCAACCTGCGGGACAG GTTTTGGCTTGTGATCAACCAGGAG GGAAACATGGTTACTGCTCGCCAGG AACCTCGCCTGGTCCTGATTTCCCTG ACCTGCGATGGTGACACCCTGACTC | 1683 |

| Name | Strand | Sequence | SEQ ID NO |
|---|---|---|---|
| | | TCAGTGCAGCCTACACAAAGGACCT | |
| | | ACTACTGCCTATCAAAACGCCCACC | |
| | | ACAAATGCAGTGCACAAGTGCAGA | |
| | | GTGCACGGCCTGGAGATAGAGGGC | |
| | | AGGGACTGTGGCGAGGCCACCGCCC | |
| | | AGTGGATAACCAGCTTCCTGAAGTC | |
| | | ACAGCCCTACCGCCTGGTGCACTTC | |
| | | GAGCCTCACATGCGACCGAGACGTC | |
| | | CTCATCAAATAGCAGACTTGTTCCG | |
| | | ACCCAAGGACCAGATTGCTTACTCA | |
| | | GACACCAGCCCATTCTTGATCCTTTC | |
| | | TGAGGCGTCGCTGGCGGATCTCAAC | |
| | | TCCAGGCTAGAGAAGAAAGTTAAA | |
| | | GCAACCAACTTCAGGCCCAATATTG | |
| | | TAATTTCAGGATGCGATGTCTATGC | |
| | | AGAGGTAACACTATGCCCCTTTGGA | |
| | | TCTTTCCTTGGATTTGACTTCTTTTTT | |
| | | AAGGATTCTTGGGATGAGCTTCTTA | |
| | | TTGGTGACGTGGAACTGAAAAGGGT | |
| | | GATGGCTTGTTCCAGATGCATTTTA | |
| | | ACCACAGTGGACCCAGACACCGGTG | |
| | | TCATGAGCAGGAAGGAACCGCTGG | |
| | | AAACACTGAAGAGTTATCGCCAGTG | |
| | | TGACCCTTCAGAACGAAAGTTATAT | |
| | | GGAAAATCACCACTCTTTGGGCAGT | |
| | | ATTTTGTGCTGGAAAACCCAGGGAC | |
| | | CATCAAAGTGGGAGACCCTGTGTAC | |
| | | CTGCTGGGCCAGTAATGGGAACCGT | |
| | | ATGTCCTGGAATATTAGATGCCTTTT | |
| | | AAAAATGTTCTCAAAAATGACAACA | |
| | | CTTGAAGCATGGTGTTTCAGAACTG | |
| | | AGACCTCTACATTTTCTTTAAATTTG | |
| | | TGATTTTCACATTTTTCGTCTTTTGG | |
| | | ACTTCTGGTGTCTCAATGCTTCAATG | |
| | | TCCCAGTGCAAAAAGTAAAGAAATA | |
| | | TAGTCTCAATAACTTAGTAGGACTT | |
| | | CAGTAAGTCACTTAAATGACAAGAC | |
| | | AGGATTCTGAAAACTCCCCGTTTAA | |
| | | CTGATTATGGAATAGTTCTTTCTCCT | |
| | | GCTTCTCCGTTTATCTACCAAGAGC | |
| | | GCAGACTTGCATCCTGTCACTACCA | |
| | | CTCGTTAGAGAAAGAGAAGAAGAG | |
| | | AAAGAGGAAGAGTGGGTGGGCTGG | |
| | | AAGAATATCCTAGAATGTGTTATTG | |
| | | CCCCTGTTCATGAGGTACGCAATGA | |
| | | AAATTAAATTGCACCCCAAATATGG | |
| | | CTGGAATGCCACTTCCCTTTTCTTCT | |
| | | CAAGCCCCGGGCTAGCTTTTGAAAT | |
| | | GGCATAAAGACTGAGGTGACCTTCA | |
| | | GGAAGCACTGCAGATATTAATTTTC | |
| | | CATAGATCTGGATCTGGCCCTGCTG | |
| | | CTTCTCAGACAGCATTGGATTTCCTA | |
| | | AAGGTGCTCAGGAGGATGGTTGTGT | |
| | | AGTCATGGAGGACCCCTGGATCCTT | |
| | | GCCATTCCCTCAGCTAATGACGGA | |
| | | GTGCTCCTTCTCCAGTTCCGGGTGA | |
| | | AAAAGTTCTGAATTCTGTGGAGGAG | |
| | | AAGAAAAGTGATTCAGTGATTTCAG | |
| | | ATAGACTACTGAAAACCTTTAAAGG | |
| | | GGGAAAAGGAAAGCATATGTCAGTT | |
| | | GTTTAAAACCCAATATCTATTTTTTA | |
| | | ACTGATTGTATAACTCTAAGATCTG | |
| | | ATGAAGTATATTTTTATTGCCATTT | |
| | | TGTCCTTTGATTATATTGGGAAGTTG | |
| | | ACTAAACTTGAAAAATGTTTTTAAA | |
| | | ACTGTGAATAAATGGAAGCTACTTT | |
| | | GACTAGTTTCAGA | |
| 3' Assay Forward Primer | | GCTTCTCAGACAGCATTGGA | 1684 |

SEQUENCE LISTING

| Name | Strand | Sequence | SEQ ID NO |
|------|--------|----------|-----------|
| 3' Assay Reverse Primer | | GAAGGAGCACTCCGTCATTAG | 1685 |
| 5' Assay Forward Primer | | AGTCCCTGCCCTCTATCTC | 1686 |
| 5' Assay reverse Primer | | CTACACAAAGGACCTACTACTGC | 1687 |
| HPRT Forward Primer | | GACTTTGCTTTCCTTGGTCAG | 1688 |
| HPRT Reverse Primer | | GGCTTATATCCAACACTTCGTGGG | 1689 |
| NHP MARC1 Forward Primer | | GACCGAGACATCCTCACCAAA | 1690 |
| NHP MARC1 Reverse Primer | | CCCAAGAATCCTCTGCATAGAC | 1691 |
| MARC1 Human cDNA (NM_022746.4) | | CTTGCCGCCGCCACCTCGCGGAGAAGCCAGCCATGGGCGCCGCCGGCTCCTCCGCGCTGGCGCGCTTTGTCCTCCTCGCGCAATCCCGGCCCGGGTGGCTCGGGGTTGCCGCGCTGGGCCTGACCGCGGTGGCGCTGGGGGCTGTCGCCTGGCGCCGCGCATGGCCCACGCGGCGCCGGCGGCTGCTGCAGCAGGTGGGCACAGTGGCGCAGCTCTGGATCTACCCTGTGAAATCCTGCAAGGGGGTGCCGGTGAGCGAGGCGGAGTGCACGGCCATGGGGCTGCGCAGCGGCAACCTGCGGGACAGGTTTTGGCTTGTGATCAACCAGGAGGGAAACATGGTTACTGCTCGCCAGGAACCTCGCCTGGTCCTGATTTCCCTGACCTGCGATGGTGACACCCTGACTCTCAGTGCAGCCTACACAAAGGACCTACTACTGCCTATCAAAACGCCCACCACAAATGCAGTGCACAAGTGCAGAGTGCACGGCCTGGAGATAGAGGGCAGGGACTGTGGCGAGGCCACCGCCCAGTGGATAACCAGCTTCCTGAAGTCACAGCCCTACCGCCTGGTGCACTTCGAGCCTCACATGCGACCGAGACGTCCTCATCAAATAGCAGACTTGTTCCGACCCAAGGACCAGATTGCTTACTCAGACACCAGCCCATTCTTGATCCTTTCTGAGGCGTCGCTGGCGGATCTCAACTCCAGGCTAGAGAAGAAAGTTAAAGCAACCAACTTCAGGCCCAATATTGTAATTTCAGGATGCGATGTCTATGCAGAGGATTCTTGGGATGAGCTTCTTATTGGTGACGTGGAACTGAAAAGGGTGATGGCTTGTTCCAGATGCATTTTAACCACAGTGGACCCAGACACCGGTGTCATGAGCAGGAAGGAACCGCTGGAAACACTGAAGAGTTATCGCCAGTGTGACCCTTCAGAACGAAAGTTATATGGAAAATCACCACTCTTTGGGCAG | 1692 |

| Name | Strand | Sequence | SEQ ID NO |
|---|---|---|---|
| | | TATTTTGTGCTGGAAAACCCAGGGA | |
| | | CCATCAAAGTGGGAGACCCTGTGTA | |
| | | CCTGCTGGGCCAGTAATGGGAACCG | |
| | | TATGTCCTGGAATATTAGATGCCTTT | |
| | | TAAAAATGTTCTCAAAAATGACAAC | |
| | | ACTTGAAGCATGGT | |
| | | GTTTCAGAACTGAGACCTCTACATT | |
| | | TTCTTTAAATTTGTGATTTTCACATT | |
| | | TTTCGTCTTTTGGACTTCTGGTGTCT | |
| | | CAATGCTTCAATGTCCCAGTGCAAA | |
| | | AAGTAAAGAAATATAGTCTCAATAA | |
| | | CTTAGTAGGACTT | |
| | | CAGTAAGTCACTTAAATGACAAGAC | |
| | | AGGATTCTGAAAACTCCCCGTTTAA | |
| | | CTGATTATGGAATAGTTCTTTCTCCT | |
| | | GCTTCTCCGTTTATCTACCAAGAGC | |
| | | GCAGACTTGCATCCTGTCACTACCA | |
| | | CTCGTTAGAGAAAG | |
| | | AGAAGAAGAGAAAGAGGAAGAGTG | |
| | | GGTGGGCTGGAAGAATATCCTAGAA | |
| | | TGTGTTATTGCCCCTGTTCATGAGGT | |
| | | ACGCAATGAAAATTAAATTGCACCC | |
| | | CAAATATGGCTGGAATGCCACTTCC | |
| | | CTTTTCTTCTCAAGC | |
| | | CCCGGGCTAGCTTTTGAAATGGCAT | |
| | | AAAGACTGAGGTGACCTTCAGGAAG | |
| | | CACTGCAGATATTAATTTTCCATAG | |
| | | ATCTGGATCTGGCCCTGCTGCTTCTC | |
| | | AGACAGCATTGGATTTCCTAAAGGT | |
| | | GCTCAGGAGGATGG | |
| | | TTGTGTAGTCATGGAGGACCCCTGG | |
| | | ATCCTTGCCATTCCCCTCAGCTAATG | |
| | | ACGGAGTGCTCCTTCTCCAGTTCCG | |
| | | GGTGAAAAAGTTCTGAATTCTGTGG | |
| | | AGGAGAAGAAAAGTGATTCAGTGA | |
| | | TTTCAGATAGACTAC | |
| | | TGAAAACCTTTAAAGGGGGAAAAG | |
| | | GAAAGCATATGTCAGTTGTTTAAAA | |
| | | CCCAATATCTATTTTTAACTGATTG | |
| | | TATAACTCTAAGATCTGATGAAGTA | |
| | | TATTTTTTATTGCCATTTTGTCCTTTG | |
| | | ATTATATTGGGAA | |
| | | GTTGACTAAACTTGAAAAATGTTTT | |
| | | TAAAACTGTGAATAAATGGAAGCTA | |
| | | CTTTGACTAGTTTCAGATCTTACTAA | |
| | | CTTCTTGGCACAAAGTTAGACTGTG | |
| | | AAAGCTGACTGAGGCTGGGCACAG | |
| | | GGGCTCATGCCTGTA | |
| | | ATTCCAGCACTTTGGGAGGCCAAGG | |
| | | TGGGAGAATGGCTTGAGCCCAGGAG | |
| | | TTTGAGACCAGCCCAGAAAATATAA | |
| | | TGGGATCCTGTCGCTACAAAATGTT | |
| | | TTTAAAATGCACTCGGTGTGGTGGT | |
| | | GTGTGCCTGCAGTCC | |
| | | TGGCTATGGCTACTCGGGAGGATGA | |
| | | GGTAGAAGGATTGGTTGAGCCCAGG | |
| | | AGCGGGAGATTGAGGCTGCAGTGA | |
| | | GTTATGATTGCACCACTACACTCCA | |
| | | GCCTGAGTGATAGAGTGAGACCCTA | |
| | | TCTCTAAAAAGAAAC | |
| | | AGGAAAAAAAAGAAAGCTGACTG | |
| | | AGGTGAATGGGCAAAGCCAGTAATT | |
| | | CTGACACCTGACCACAGCTGGGTCT | |
| | | TCTGCATAATGGACCTCCTCACCCA | |
| | | CAGCCTCCCAGGCAAGCACCCATGT | |
| | | TTGAAGGACTATCAAG | |
| | | TCAACATGCTTTTTACCAAAAGCTG | |
| | | CACATTTTTCACTTTGATTTTATAAA | |
| | | AGAGGTCAGTAATCGCTGAAATCTA | |
| | | GCTGAGCCCTGAAGTAAAGTTCTGA | |
| | | GCAAAGAGGTGCATGTGCTTGTTTT | |
| | | ATGGTTGGTGAATT | |

SEQUENCE LISTING

| Name | Strand | Sequence | SEQ ID NO |
|------|--------|----------|-----------|
| | | ATTACAGTTTGTTTTCTGCATGCTTG GCATGAGGTGAATAATTACATCAAT TTTCCAGAGAACCTGGGCCATCACC TTCCCCAACAAGTCCAGTTGATGTT GAAACTACAGATAGATTGAGACAA AGCGAAGTGTTCAGC AAGTAGCATTACTAATGGGACCGGG GGACCCGTGGGAGAGTGAGTGTACA CAGGATTTAGGAAACCATGTGAATA TGGGCTCTCTGGGAATAGCCAATAG GTAGGGAGCAATCAGAAACCCAAG GTTTGGTGGCTCTTCC TAGGTATTTATAATTAGTGGCAAGT GAAAGCCTTAGTCCTGAATTTCTAA CCACTTGTAAGAACTAACAGCCACT TCTCTGTGCCCCGTCCGGGCAGTAA CCATCATTCTCCATGGACAGGCTCT CGGGGTAGCTAGCTC TGCAGGGCAGCACCCACGTGGAAG GGAGCACCCAGAAACCCTCCTCACT GGGCAGACCTGTCCTTCTGTGCCTC ACAGTGTGAGGAAGATTCCTGTTTG AAGAGAGAAGTTCCAGTGACCTCTA GAATCTCAGAGTAGTT GCCAAGCTTTCTGTCAGTGAGATTT AAAGGCCATTTACTTGTGTTTATTTT ATATTTAATGAGTTGGTTAATGCCA GAGACAAAGCTGATATCCCATTTAT TTTGGATACTGAGCATTTGCACACT ATTCCACTTGAAAT ATAGAATCAGGAATGTAGGCCATCC CAGACTTTCAGATCTTACAACAGCA AATGACAGATGTTTGAGATCAGGCC AAAATATCCACCCTCGGTGGGCATC TCCTCTGTGTGGCAACTTATGCTGCA GCCACAGTGGGGAG TCACAAACTCAGAGCTGGAGGTCTT GAAAAGGACAATGTGGGCCAGGCT CCGGAGGGGCTGCCTAAAGGCTTGC TTTTGTGACTCTCCTGCAGAAAATGT TAGAAACTTCCAACCGAAAGACGAG GGCAGCAACTTATAC ACACGAAGGCAGAAAGAAATTGGG GAAGGGGAGGCTGTTGGAATTCAGG CCGTTGTCCTATAGGGAGAAATACT CCTCCTCTCCTTCTCCCTTTACTGAT AACGGGGCATGGTGAGGAGATGAG CTTGTGAGGGTCTGCC AGTTTGGTAAGAGTGCATGGGGAGG TTGGGTAAATTAGACTAGCCAAATG GGACTTCGGGAAACCATTTATGAGG CTGTCACCAACAGTGATGGCAGGCT GAAATTCCAGGCAAGTGCTCCCAGC ATTCCAAGAGTGTAT CAAATTAAAGCAACCCATGATGGTG GAGAACAGATACATTAAAGTTCCTT GAAAATGACAGAGTGGCTCTCAGAC CAGACCTTGATTGTGGGTATAATCG GAGTGTTGCTACCACACCCTAACAC TGCATTTCCCGTGTT TTATTGGTCCATGGAATTCTGAAAG TTTGCCTTTCGGGATGCTTCTAAAAA CAATTCCATGGACCAGTAAGTTTGG AAAGTCCTGCGTGCCTCACTTCTCTT CAAAGGCAAAAGGCTCTGGAGAGG CCTTCATGAAGACA TCTGTGTTTAATGCTGCCCTTCCCAA AGGTCTGTTTTTGACTGTCTTTTGAG AAATGATCCTCTGATCTCTAGGCAG AATGCCAGTGAGCCAAGGAATCCCA GTTAGCAGGAGGGGTGCACTCATGG GAAGACTGAAGAA | |

SEQUENCE LISTING

| Name | Strand | Sequence | SEQ ID NO |
|------|--------|----------|-----------|
| | | GTTAAAAGTTCCCGCCAAGTGAAGG AGACCTATCTTGGGACACTTCCCCTT GTCCTCTCCCTTGCCCCTCTTGCTGG AGTAAAAGGATGGAACTGGGACTTG ATAGGTTAAAGGAGGTGTGGAGAA GTGTCTTAGACCAG CTCTCCTGTTGTGGGCCTTAGGGAG AAGCACTCTCTTTCTTCGGGATCATT TTCCAAACATGCATTTTTGGATGGA TAGGGTGGATCAGGGTGAGGGAAG GGAAACCAAACTCTCTCTAACCTTG CCCTTACAGCAATAC CTGTGATGTAAGTTACAAAACCACC TGTGATGAAAGTGCTCCAGGATGCT TCATGCACCAGGGAGGGGTGCCCTG TTTCTCTTCTGCTAGCTTCTCCTTTCT TTTTTTTTTTCTTCTTTTTTTGAGA CAGTGTCTCAC TCTGTTGCCAGGCTGGAGTGCAGTG GTGAGATCTCAGCTCACTGCAGCCT CTGCCTCCCAGGTTCAAGCAATTCTT CTGCCTCAGCCTCCCGAGTAGCTGG TGTGTCTGGAGTTGGTTCCTTCTGGT GGGTTCTTGGTCT CGCTGACTTCAAGAATGAAGCCACA GACCTTCGCAGTGAGTGTTACAGCT CTTAAAGGTGGCACGGACCCAAAGT GAGCAGTAGCAAGATTTATTGTGGA GAGCGAAAGAACAAAGCTTCGGAA GGGGACCCAAATGGGC TGCTGCTGCTGGCTGGGGTGGCCAC CTTTTATTCCCTTATTTGTCCCTGCC CATGTCCTGCTGATTGCTCCATTTTA CAGAGTGCTGATTGGTCCATTTTAC AGAGTGCTGATTGGTGCATTTACAA TCCTTTAGCTAGA CACAGAGTGCCGATTGGTGAGTTTT TACAGTGCTGATTGGTGCATTTACA ATCCTTTAGCTAGACACAGAACACT GACTGGTGCATTTATAATCCTCTAG CTAGAAAGAAAAGTTCTCCAAGTCC CCACTAGACCCAGGA AGTCCAGCTGGCTTCACCTCTCACT GGGACTACAGGTGCACACCACCACA CCCAGCTAATTTTTGTATTTTTAGTA GAGACGGGGTTTCACCATGTTGTTC AGGATGGTCTCGAACTCTTGATCTC GTGATCTGCCCGCC TCGGCCTCCCAAAGTGCTGGGATTA CAGTTGTGAGCCACCACGCCCGGCC CTAGCTTTTCCTTTCTGTTGCAAGTC CTCTCAACTAGTGTTGCCTTCCACCC TACAAAGCAGAATTACCTCAGAAGT CCTATGGCCCTGA CTCTATCTATGTCTGCACAAAGCAC TACTGTGCTTTGCTGTCTGCAAGAA CAGAGATTGTTTGCTTCAACCACTTT CTCTGAATGGATGAATGAGTTATGA TGATATCTAAAGTTACCCAATTTCA AGCAAGAGGAAGAA TCTGGCTCGGTACCACAGATGTTCTT GGAATTGGGATAGTAAAAAAGTCCC TGAGGCATCCCTTGGTCTGCTCTGA CCACACTCTCTTCACAGGAAGAGGC TTGGGCCACAGCTCTGACTATAACT CTGCTCTTCCTCCA AACACAGCTGAGGAATTGGGTGGTG GGGCACCTGCTCCCATGCTCTGTGG CCTGGCTCAGAGAGAAGAGTTGCCT TAATTACATTATTATTCTTCCTGGAC AGGCTGTAGGTTGTGTAAAGTAACA AAAAGGACTGAGAA | |

SEQUENCE LISTING

| Name | Strand | Sequence | SEQ ID NO |
|---|---|---|---|
| | | GTGACTTCCCATTCAGCCTCTTCCAA GGCCATTTTTGATAGGCAGGTCAAA TTCACTCACATTTGGTTATTTGTTGG CCAGTCTAGTGCATTCACCCTTGCTG GTCCTCAGTCATGCTCCTTTACCTTT ACAGAGCATCCTAGACTGCTCTTCC TCTTACCTTCCTTGTGAAACCCACAA CCCCTAGTCCCTCCCCTTCCCTGGCA TTTGTTATGCCCTCTACCAATCCCTG ACCTGGTATTGGTCAGTCTCCAATC CTGGTGGATCCCTGTGGGAACTAAG TTAAGTCTAACTTTTGTCTCCCTCTT TAGAATTTACTGGGAGTACTGTAAA TAAACTATTGTTGTTATAATTATTTC TGATTAACATTTTTACACCTAACAA AGTCTCAGAGAGATTGAATTTACTG GGTTGAAGGGAGGAGCACCTTCCAC ATGACCTGCCCAGCAATTAAAGCCG CTTGTTAGTCCGAGGCCCAGGACGG CCGAGG ACAGCTGGAGAGCTCTTCGTTGCAG GCAGCTCTGGTTAACATCAACCGGG AAAGCTCTTTGTAAACACATGAATA ATTGATCGTCCAGCGCTCACATAGC TACCGCGGATCTGAGCCCGTATGAC TCATTTGCGAGCCAT TCCTGTCGTCTGGATGCCATAACATT GGAGGAATGATGATCGTTTCTTGGA GGTTCTTCTGTGGCCAGAGTTGCCA AGACCAAGGCTGTAATGGTTTGTTA TGATGACCTTTGTTATTCCATTAGGC TCAATTGCTTTAA AAAATGATGTGTGCATACTTTAGGA ACGTTTTTACCCTTTATGTTGACCTG ACATCATAGTTTATATTATAAAATG TATTAATGACAGAAGAGTGTTTTCA TGTCCCAAGGACAAATTTTAACAAC CATAATCTGCCCTC AGTCATCATAAATATAAATGTATTG GTCAAACAGATCTCGTTAATGTGGC CAAGATAAATGCAAGTCTATATTTT AAGGCAGTCGAAGTCCTAGAGAATA TATCTGGAGCTTTTGTGGGGCTAAG AGATCTTGTATATAT GCTATCAAAAGGCTGAGAAAATTAA CATGTTCCCCCCTCTGATTTTGCATT GGACAGATATAAATGTCTTGGGGAT GTCAAGTAAGATTGTTCACATAGTT TCTGGACACCATTAATGCCTGATGG GGTGAATCTTAGTT CTTAAAGCTATATTCTGCTCATTATG CTCACAGGGCTTTTGAAAAGAGAAC AAAATAAAGATTTCAAGTCTTAGCA A | |
| MARC1 *Macaca fascicularis* cDNA (XM_005540898.2) | | AAAAAAAAAGTGGTAAGTGAGCTG TAGCCCTGGGTAAATTCTGGAAGTG ATGAAATGGAAGAATCAGAACTTTA AAGTCAACCATTAAAATAGGGGAGC CATTTTTTCCTCTTAAATTTTCAAAG AGGAATTCAGGAGGG AGATAAACAGAAACACATATTTGGT GCCCCGGAGCTGCCTTTCCGAGGAG GATCAAGTGGTACGTCCTGCGGAGC TGTGTCCTTTACAGACAGGGTGTGA CCTGGGGTTGGAAGAGAAGAGAAG AGAGCAGAAAAGCAGG ACAGATAAGTGTTCAGGCCAGTAAA GACAGAGCCTCCCTGAGCACGGAAC TGCTCTGCAGTGAGTTGCCATCTGG AGGAGAGGGTTGTTCTTTTCTCTTGG CGAACTCCCGCTTCTCTCTTCCAAGG CACCCTTGCCCTG | 1693 |

SEQUENCE LISTING

| Name | Strand | Sequence | SEQ ID NO |
|------|--------|----------|-----------|
| | | CATGGACAATTCTGGCTGAGTCTTG | |
| | | AAATGTACACTCCTGGCTCAGGGGA | |
| | | CCATGGCTGAGCTGCGGATGACACA | |
| | | GGCTCTCGACCAAACTTCAGTCTCC | |
| | | TCTGAGCCCTTTTCTTCGTGAGGCCT | |
| | | TGACCTTGCCACCC | |
| | | TACTCCCTGCAGAGCCCAGTTTAGC | |
| | | AAGAATCCTGCTTAGTCAGTTTCCA | |
| | | GAGTATTCTCCCATCCTTGATATCTG | |
| | | ATCATCCTTGATATCTGCTCAGATTC | |
| | | CTCATCTGTCACCCTCAGTGTGTAA | |
| | | GTCCTTGCCTAGT | |
| | | TCAGTAGAATCCTGTTAAGTGGGTT | |
| | | TATCAAGAATCCTCTACACTTGATG | |
| | | TCTCCTCTTAGAGATTTTTCATTCAC | |
| | | TGACCCCAGGAACTTTGCTCTTTG | |
| | | GCTATAAACCCCCAGCAGTCTTCGC | |
| | | TGTAATACAGAGCT | |
| | | GAGCCTAATCTCTTTCCCCTATTGTG | |
| | | ATGCCCCTGTTACAATAGCCGTGAA | |
| | | TAGTCTTCCTTACCTTTTTAATAAGC | |
| | | GTTTGAGTAATTTTTTCCTTTGATAG | |
| | | CTTGGTACATCAAACAGGAGCCTGA | |
| | | CTCCTAAACCAT | |
| | | GCTGTTCGGGTGTGCTGATATTGTTG | |
| | | ACTGGAATATAACCTGATTTGGAAG | |
| | | TGACAAGTGACTGAGGTGAGTGCCT | |
| | | GCAGGACCAGGTGACATTCCCTCCC | |
| | | GCCAGAAGCAGCCTGGGGACCTTGT | |
| | | GCAGTGCTGAACTT | |
| | | CTGAGCCAAGGCCTTGCCAATGCAG | |
| | | CTGCAGCTGAGGCTCCCCGCCGGGA | |
| | | GCGTAGAAGGCGCTCTCAGACGCCC | |
| | | ATTGCCGCTCCGAACTGCCGCTGGG | |
| | | AGAACTCTGGCCTTGTCTCGCTGGC | |
| | | GCAGAGGGCCTGGTA | |
| | | GCATCCTCCTCCACCAGACCCCCAC | |
| | | TCTTTGGAACCTCCCTAAACCCTGG | |
| | | GCAGCCTGCGGGGACGGCGGCCGC | |
| | | AGCAGAGAGCTGGACACTGCGCAG | |
| | | GCCAGGCAGGGCCAACCCGCTCTCT | |
| | | ACTATTCCTGGGAGAAG | |
| | | CTGCTGCCCGCTGTCTGATTTTTAAT | |
| | | TTCAAAATCACGCTTTGTCCTGCAA | |
| | | ATGTTGTCTATTGTTTATTTTAGGTC | |
| | | AAATAACCCCATAAATACGTAAGTA | |
| | | AATAAACTGGTCACTTGCAGAGATC | |
| | | GTGGGGAGGGCACGGCGCCCTGA | |
| | | GCTGCAGGCGACGGAAGGTTGCAG | |
| | | AAGCCATGGGGCGCAGACCAAGTG | |
| | | GAAGCTGAGCCGCCACCTCCCACTC | |
| | | CCCGCGCCGCCCCCCAAAAGGACGC | |
| | | ACTGCTCTGATTGGCCCGGAAGGGT | |
| | | TTGGGAACTGCCCACCCTTTGGGCT | |
| | | CAGGGCCAAAGGCCGCACCTTCCCC | |
| | | CAGCTGCCCGGGGCTACCAGCGCGC | |
| | | TGCGGCCTTGCCGCCGGCACCTCGC | |
| | | GGAGAAGCCAGCCATGGGCGCCGC | |
| | | CGGTTCCTCCGCGCTGGCCGGC | |
| | | TTTGTCCTCCTCGCTCAGCCCGGCC | |
| | | CGGGTGGCTCGGGGTCGCCGTGCTG | |
| | | GGACTGACCGCGGTGGCGCTGGGGG | |
| | | CTGTCGCCTGGCGCCGCGCATGGCC | |
| | | CACGCAGCGCCGGCGGCTGCTGCAG | |
| | | CAGGTGGGCACAGT | |
| | | GGCGCAGCTCTGGATCTACCCTGTG | |
| | | AAATCCTGCAAGGGGGTGCCAGTGA | |
| | | GCGAGGCCGAGTGCACTGCCATGGG | |
| | | GCTGCGCAGCGGCAACCTGCGGGAC | |
| | | AGGTTTTGGCTTGTGATCAACCAGG | |
| | | AGGGAAACATGGTTA | |

SEQUENCE LISTING

| Name | Strand | Sequence | SEQ ID NO |
|------|--------|----------|-----------|
| | | CCGCTCGCCAGGAACCTCGCCTGGT CCTGATTTCCCTGACCTGTGATGGTG ACACCCTGACTCTCAGTGCAGCCTA CACAAAGGATCTACTACTGCCCATC AAAACGCCCACCACAAATGCAGTGC GCAAGTGCAGAGTC CATGGCCTGGAGATTGAGGGCAGAG ACTGTGGTGAGGCCGCCGCCCAGTG GATAACCAGCTTCCTGAAGTCACAG TCCTACCGCCTGGTGCACTTCGAGC CTCACATGCGACCGAGACATCCTCA CCAAATAGCAGACTT GTTCCGACCCAAGGACCAGATTGCT TACTCAGACACCAGCCCATTCATGA TCCTTTCTGAGGCGTCGCTAGCGGA TCTCAACTCCAGGCTAGAGAAGAAA GTTAAAGCAACCAACTTCAGGCCCA ATATTGTAATTTCAG GATGCGATGTCTATGCAGAGGTAAC GCTATGCCCCTTTGCATCTTTCCTTG GATTTGACTTCTTTTTTAAGGATTCT TGGGACGAGCTTCTTATTGGTGACG TGGAACTGAAAAGGTTGATGGCTTG TTCCAGATGCATT TTAACCACAGTGGACCCAGACACCG GCGTCATGAGCAGGAAGGAGCCGCT GGAAACACTGAAGAGTTATCGCCAG TGTGACCCTTCAGAACGAAAGTTAT ATGGAAAATCACCACTCTTTGGGCA GTATTTTGTGCTGGA AAACCCAGGGACCATCAAAGTGGG AGACCCTGTGTACCTGCTGGGCCAG TAATGGGAACTGTATGTCCTGGAAT ATTAGATGCCTTTAAAAAATGTTCT CAAAAATGACAACACTTGAAGCATG GTGTTTCAGAACTGAG ACCTCAACATTTTCTTTAAATTTGTG ATTTTCACATTTTTCCTCTTTTGGAC TTCTCGTGTCTCAATGCTTCAATGTC CCAGTGCACAAAGCAAAGAAATAT AGTCTTGATAACTTAGTAGGCTTTC AGTAAGACACTTAAGTGACAAGACA GGATTCTGAAAACTCCCTGTTTAAC TGATTATGGAATAGTTCTTTCTCCTG CTTTGCCATTTATCTACCAAGAGTGC AGACTTCCATCCTGTCACTACCACTC ATGAGGGAAAGAGAAGAAGAGAAA GAGGAAGAGTGGGTAGGCCAGAAG AATGTCCTAGAATGTGTTATTACCC CTGTGCATGAGGTATGCAATGAAAA TTAAATAGCTCCCCAAATATGGCTG GAATGTCACTTGCCTTTTCTTCTGAA GCCCCGGGCTAGCTTTTGAAATGGC ATGAAGACTGAGGTGACCTTCAGGA AGCACTTCAGATATTAATTTTCCATA GATCTGGATCTGGCCCCGCTGCTTCT CAGACAGCATTGGATTTCCTAAAGG TGCTCAGGAGGGTGGTTGTGTAGTC ACGGAGGACCCCTGGATCCTTGCCA TTCCCCTCAGCTAATGACTGAGTGC TCCTTCTCCAGTTCTGGGTGAAAA AGTTCTGAAGTCTGTGGAGGAGAAG AAAAGTGATTCAGTGATTTCAAATG GATACTGAAAACCTTTAAAGGGGGA AAAGGAAAGCGTATGTCAGTTGTTT AAAACCCAATATCTACTTTTTTAACT GATTGCATAACTCTAAGATCTGATG AAGTATATTTTTATTGCCATTTTGT CCTTTGATTGTATTGGGAAGTTGACT AAACTTGAAAAATGTTTTTAAAACT GTGAATAAATGGAAGCTACTTTGAC TAGTT | |

SEQUENCE LISTING

| Name | Strand | Sequence | SEQ ID NO |
|---|---|---|---|
| Probe | | CAGGAGGATG GTTGT | 1694 |
| Probe | | CCACCACAAA TGCA | 1695 |
| Probe | | GTCGCAAGCT TGCTGGT | 1696 |

LIST OF EMBODIMENTS

1. An RNAi oligonucleotide for reducing MARC1 expression, the oligonucleotide comprising a sense strand and an antisense strand, wherein the sense strand and the antisense strand form a duplex region, wherein the antisense strand comprises a region of complementarity to a MARC1 mRNA target sequence of any one of SEQ ID NOs: 1-384, and wherein the region of complementarity is at least 15 contiguous nucleotides in length differing by no more than 3 nucleotides from the MARC1 mRNA target sequence.
2. The RNAi oligonucleotide of embodiment 1, wherein the sense strand is 15 to 50 nucleotides in length.
3. The RNAi oligonucleotide of embodiments 1 or 2, wherein the sense strand is 18 to 36 nucleotides in length.
4. The RNAi oligonucleotide of any one of embodiments 1 to 3, wherein the antisense strand is 15 to 30 nucleotides in length.
5. The RNAi oligonucleotide of any one of embodiments 1 to 4, wherein the antisense strand is 22 nucleotides in length and wherein antisense strand and the sense strand form a duplex region of at least 19 nucleotides in length, optionally at least 20 nucleotides in length.
6. The RNAi oligonucleotide of any one of embodiments 1 to 5, wherein the region of complementarity is at least 19 contiguous nucleotides in length, optionally at least 20 nucleotides in length.
7. The RNAi oligonucleotide of any one of embodiments 1 to 6, wherein the 3' end of the sense strand comprises a stem-loop set forth as S1-L-S2, wherein 51 is complementary to S2, and wherein L forms a loop between S1 and S2 of 3-5 nucleotides in length.
8. An RNAi oligonucleotide for reducing MARC1 expression, the oligonucleotide comprising a sense strand of 15 to 50 nucleotides in length and an antisense strand, wherein the sense strand and the antisense strand form a duplex region, wherein the antisense strand comprises a region of complementarity to a MARC1 mRNA target sequence of any one of SEQ ID NOs: 1-384, and wherein the region of complementarity is at least 15 contiguous nucleotides in length differing by no more than 3 nucleotides from the MARC1 mRNA target sequence.
9. An RNAi oligonucleotide for reducing MARC1 expression, the oligonucleotide comprising a sense strand of 15 to 50 nucleotides in length and an antisense strand of 15 to 30 nucleotides in length, wherein the sense strand and the antisense strand form a duplex region, wherein the antisense strand comprises a region of complementarity to a MARC1 mRNA target sequence of any one of SEQ ID NOs: 1-384, and wherein the region of complementarity is at least 15 contiguous nucleotides in length differing by no more than 3 nucleotides from the MARC1 mRNA target sequence.
10. An RNAi oligonucleotide for reducing MARC1 expression, the oligonucleotide comprising a sense strand of 15 to 50 nucleotides in length and an antisense strand, wherein the sense strand and the antisense strand form a duplex region, wherein the antisense strand comprises a region of complementarity to a MARC1 mRNA target sequence of any one of SEQ ID NOs: 1-384, and wherein the region of complementarity is 19 contiguous nucleotides in length, differing by no more than 3 nucleotides from the MARC1 mRNA target sequence.
11. An RNAi oligonucleotide for reducing MARC1 expression, the oligonucleotide comprising a sense strand of 18 to 36 nucleotides in length and an antisense strand, wherein the sense strand and the antisense strand form a duplex region, wherein the antisense strand comprises a region of complementarity to a MARC1 mRNA target sequence of any one of SEQ ID NOs: 1-384, and wherein the region of complementarity is 19 contiguous nucleotides in length, differing by no more than 3 nucleotides from the MARC1 mRNA target sequence.
12. An RNAi oligonucleotide for reducing MARC1 expression, the oligonucleotide comprising a sense strand of 18 to 36 nucleotides in length and an antisense strand of 22 nucleotides in length, wherein the sense strand and the antisense strand form a duplex region, wherein the antisense strand comprises a region of complementarity to a MARC1 mRNA target sequence of any one of SEQ ID NOs: 1-384, and wherein the region of complementarity is 19 contiguous nucleotides in length, differing by no more than 3 nucleotides from the MARC1 mRNA target sequence.
13. An RNAi oligonucleotide for reducing MARC1 expression, the oligonucleotide comprising a sense strand of 18 to 36 nucleotides in length and an antisense strand of 22 nucleotides in length, wherein the sense strand and the antisense strand form a duplex region, wherein the 3' end of the sense strand comprises a stem-loop set forth as S1-L-S2, wherein S1 is complementary to S2, and wherein L forms a loop between S1 and S2 of 3-5 nucleotides in length, wherein the antisense strand comprises a region of complementarity to a MARC1 mRNA target sequence of any one of SEQ ID NOs: 1-384, and wherein the region of complementarity is 19 contiguous nucleotides in length, differing by no more than 3 nucleotides from the MARC1 mRNA target sequence.
14. An RNAi oligonucleotide for reducing MARC1 expression, the oligonucleotide comprising a sense strand of 36 nucleotides in length and an antisense strand of 22 nucleotides in length, wherein the sense strand and the antisense strand form a duplex region, wherein the 3' end of the sense strand comprises a stem-loop set forth as S1-L-S2, wherein S1 is complementary to S2, and wherein L forms a loop between S1 and S2 of 3-5 nucleotides in length, wherein the antisense strand comprises a region of complementarity to a MARC1 mRNA target sequence of any one of SEQ ID NOs: 1-384, and wherein the region of complementarity is 19 contiguous nucleotides in length, differing by no more than 3 nucleotides from the MARC1 mRNA target sequence.

15. An RNAi oligonucleotide for reducing MARC1 expression, the oligonucleotide comprising a sense strand of 36 nucleotides in length and an antisense strand of 22 nucleotides in length, wherein the sense strand and the antisense strand form a duplex region of at least 19 nucleotides in length, optionally 20 nucleotides in length, wherein the 3' end of the sense strand comprises a stem-loop set forth as S1-L-S2, wherein S1 is complementary to S2, and wherein L forms a loop between S1 and S2 of 3-5 nucleotides in length, wherein the antisense strand comprises a region of complementarity to a MARC1 mRNA target sequence of any one of SEQ ID NOs: 1-384, and wherein the region of complementarity is 19 contiguous nucleotides in length, differing by no more than 3 nucleotides from the MARC1 mRNA target sequence.

16. A double stranded RNAi oligonucleotide for reducing MARC1 expression, the oligonucleotide comprising:
(i) an antisense strand of 19-30 nucleotides in length, wherein the antisense strand comprises a nucleotide sequence comprising a region of complementarity to a MARC1 mRNA target sequence, wherein the region of complementarity is selected from SEQ ID NOs: 385-768, and
(ii) a sense strand of 19-50 nucleotides in length comprising a region of complementarity to the antisense strand, wherein the antisense and sense strands are separate strands which form an asymmetric duplex region having an overhang of 1-4 nucleotides at the 3' terminus of the antisense strand.

17. The RNAi oligonucleotide of embodiment 16, wherein the 3' end of the sense strand comprises a stem-loop set forth as S1-L-S2, wherein 51 is complementary to S2, and wherein L forms a loop between S1 and S2 of 3-5 nucleotides in length.

18. The RNAi oligonucleotide of any one of embodiments 7 and 13-17, wherein L is a triloop or a tetraloop.

19. The RNAi oligonucleotide of embodiment 18, wherein L is a tetraloop.

20. The RNAi oligonucleotide of embodiment 19, wherein the tetraloop comprises the sequence 5'-GAAA-3'.

21. The RNAi oligonucleotide of any one of embodiments 18-20, wherein the S1 and S2 are 1-10 nucleotides in length and have the same length.

22. The RNAi oligonucleotide of embodiment 21, wherein S1 and S2 are 1 nucleotide, 2 nucleotides, 3 nucleotides, 4 nucleotides, 5 nucleotides, 6 nucleotides, 7 nucleotides, 8 nucleotides, 9 nucleotides, or 10 nucleotides in length.

23. The RNAi oligonucleotide of embodiment 22, wherein S1 and S2 are 6 nucleotides in length.

24. The RNAi oligonucleotide of any one of embodiments 18 to 23, wherein the stem-loop comprises the sequence 5'-GCAGCCGAAAGGCUGC-3' (SEQ ID NO: 1681).

25. The RNAi oligonucleotide of any one of embodiments 1-24, comprising a nicked tetraloop structure.

26. The RNAi oligonucleotide of any one of embodiments 1-24, comprising a nick between the 3' terminus of the sense strand and the 5' terminus of the antisense strand.

27. The RNAi oligonucleotide of any one of embodiments 1-26, wherein the antisense and sense strands are not covalently linked.

28. The RNAi oligonucleotide of any one of embodiments 1 to 15 and 17-27, wherein the antisense strand comprises an overhang sequence of one or more nucleotides in length at the 3' terminus.

29. The RNAi oligonucleotide of any one of embodiments 16-28, wherein the overhang comprises purine nucleotides.

30. The RNAi oligonucleotide of embodiment 29, wherein the 3'-overhang sequence is 2 nucleotides in length.

31. The RNAi oligonucleotide of embodiment 30, wherein the 3'-overhang is selected from AA, GG, AG, and GA.

32. The RNAi oligonucleotide of embodiment 31, wherein the overhang is GG or AA.

33. The RNAi oligonucleotide of embodiment 31, wherein the overhang is GG.

34. The RNAi oligonucleotide of any one of the preceding embodiments, wherein the oligonucleotide comprises at least one modified nucleotide.

35. The RNAi oligonucleotide of embodiment 34, wherein the modified nucleotide comprises a 2'-modification.

36. The RNAi oligonucleotide of embodiment 35, wherein the 2'-modification is a modification selected from 2'-aminoethyl, 2'-fluoro, 2'-O-methyl, 2'-O-methoxyethyl, and 2'-deoxy-2'-fluoro-β-d-arabinonucleic acid.

37. The RNAi oligonucleotide of any one of embodiments 34 to 36, wherein all nucleotides comprising the oligonucleotide are modified, optionally wherein the modification is a 2'-modification selected from 2'-fluoro and 2'-O-methyl.

38. The RNAi oligonucleotide of any one of embodiments 34-37, wherein about 10-15%, 10%, 11%, 12%, 13%, 14%, or 15% of the nucleotides of the sense strand comprise a 2'-fluoro modification.

39. The RNAi oligonucleotide of any one of embodiments 34-38, wherein about 25-35%, 25%, 26%, 27%, 28%, 29%, 30%, 31%, 32%, 33%, 34%, or 35% of the nucleotides of the antisense strand comprise a 2'-fluoro modification.

40. The RNAi oligonucleotide of any one of embodiments 34-39, wherein about 25-35%, 25%, 26%, 27%, 28%, 29%, 30%, 31%, 32%, 33%, 34%, or 35% of the nucleotides of the oligonucleotide comprise a 2'-fluoro modification 41. The RNAi oligonucleotide of any one of embodiments 34-40, wherein the sense strand comprises 36 nucleotides with positions 1-36 from 5' to 3', wherein positions 8-11 comprise a 2'-fluoro modification.

42. The RNAi oligonucleotide of any one of embodiments 34-41, wherein the antisense strand comprises 22 nucleotides with positions 1-22 from 5' to 3', and wherein positions 2, 3, 4, 5, 7, 10, and 14 comprise a 2'-fluoro modification.

43. The RNAi oligonucleotide of any one of embodiments 34-42, wherein the remaining nucleotides comprise a 2'-O-methyl modification.

44. The RNAi oligonucleotide of any one of the preceding embodiments, wherein the oligonucleotide comprises at least one modified internucleotide linkage.

45. The RNAi oligonucleotide of embodiment 44, wherein the at least one modified internucleotide linkage is a phosphorothioate linkage.

46. The RNAi oligonucleotide of embodiment 45, wherein the antisense strand comprises a phosphorothioate linkage (i) between positions 1 and 2, and between positions 2 and 3; or (ii) between positions 1 and 2, between positions 2 and 3, and between positions 3 and 4, wherein positions are numbered 1-4 from 5' to 3'.

47. The RNAi oligonucleotide of embodiment 45 or 64, wherein the antisense strand is 22 nucleotides in length, and wherein the antisense strand comprises a phosphorothioate linkage between positions 20 and 21 and between positions 21 and 22, wherein positions are numbered 1-22 from 5' to 3'.
48. The RNAi oligonucleotide of any one of embodiments 1-47, wherein the antisense strand comprises a phosphorylated nucleotide at the 5' terminus, wherein the phosphorylated nucleotide is selected from uridine and adenosine.
49. The RNAi oligonucleotide of embodiment 48, wherein the phosphorylated nucleotide is uridine.
50. The RNAi oligonucleotide of any one of the preceding embodiments, wherein the 4'-carbon of the sugar of the 5'-nucleotide of the antisense strand comprises a phosphate analog.
51. The RNAi oligonucleotide of embodiment 50, wherein the phosphate analog is oxymethylphosphonate, vinylphosphonate, or malonylphosphonate, optionally wherein the phosphate analog is a 4'-phosphate analog comprising 5'-methoxyphosphonate-4'-oxy.
52. The RNAi oligonucleotide of any one of the preceding embodiments, wherein at least one nucleotide of the oligonucleotide is conjugated to one or more targeting ligands.
53. The RNAi oligonucleotide of embodiment 42, wherein each targeting ligand comprises a carbohydrate, amino sugar, cholesterol, polypeptide, or lipid.
54. The RNAi oligonucleotide of any one of embodiments 17-53, wherein the stem loop comprises one or more targeting ligands conjugated to one or more nucleotides of the stem loop.
55. The RNAi oligonucleotide of embodiment 54, wherein the one or more targeting ligands is conjugated to one or more nucleotides of the loop.
56. The RNAi oligonucleotide of embodiment 55, wherein the loop comprises 4 nucleotides numbered 1-4 from 5' to 3', wherein nucleotides at positions 2, 3, and 4 each comprise one or more targeting ligands, wherein the targeting ligands are the same or different.
57. The RNAi oligonucleotide of any one of embodiments 52-56, wherein each targeting ligand comprises a N-acetylgalactosamine (GalNAc) moiety.
58. The RNAi oligonucleotide of embodiment 57, wherein the GalNAc moiety is a monovalent GalNAc moiety, a bivalent GalNAc moiety, a trivalent GalNAc moiety or a tetravalent GalNAc moiety.
59. The RNAi oligonucleotide of any one of embodiments 17 to 58, wherein up to 4 nucleotides of L of the stem-loop are each conjugated to a monovalent GalNAc moiety.
60. The RNAi oligonucleotide of any one of embodiments 1-59, wherein the region of complementarity is fully complementary to the MARC1 mRNA target sequence at nucleotide positions 2-8 of the antisense strand, wherein nucleotide positions are numbered 5' to 3'.
61. The RNAi oligonucleotide of any one of embodiments 1-59, wherein the region of complementarity is fully complementary to the MARC1 mRNA target sequence at nucleotide positions 2-11 of the antisense strand, wherein nucleotide positions are numbered 5' to 3'.
62. The RNAi oligonucleotide of any one of embodiments 1 to 61, wherein the sense strand comprises a nucleotide sequence of any one of SEQ ID NOs: 1537-1570.
63. The RNAi oligonucleotide of any one of embodiments 1 to 62, wherein the antisense strand comprises a nucleotide sequence of any one of SEQ ID NOs: 1573-1606.
64. The RNAi oligonucleotide of any one of embodiments 1 to 63, wherein the sense strand and antisense strands comprise nucleotide sequences selected from the group consisting of:

(a) SEQ ID NOs: 1537 and 1573, respectively;
(b) SEQ ID NOs: 1538 and 1574, respectively;
(c) SEQ ID NOs: 1539 and 1575, respectively;
(d) SEQ ID NOs: 1540 and 1576, respectively;
(e) SEQ ID NOs: 1541 and 1577, respectively;
(f) SEQ ID NOs: 1542 and 1578, respectively;
(g) SEQ ID NOs: 1543 and 1579, respectively;
(h) SEQ ID NOs: 1544 and 1580, respectively;
(i) SEQ ID NOs: 1545 and 1581, respectively;
(j) SEQ ID NOs: 1546 and 1582, respectively;
(k) SEQ ID NOs: 1547 and 1583, respectively;
(l) SEQ ID NOs: 1548 and 1584, respectively;
(m) SEQ ID NOs: 1549 and 1585, respectively;
(n) SEQ ID NOs: 1550 and 1586, respectively;
(o) SEQ ID NOs: 1551 and 1587, respectively;
(p) SEQ ID NOs: 1552 and 1588, respectively;
(q) SEQ ID NOs: 1553 and 1589, respectively;
(r) SEQ ID NOs: 1554 and 1590, respectively;
(s) SEQ ID NOs: 1555 and 1591, respectively;
(t) SEQ ID NOs: 1556 and 1592, respectively;
(u) SEQ ID NOs: 1557 and 1593, respectively;
(v) SEQ ID NOs: 1558 and 1594, respectively;
(w) SEQ ID NOs: 1559 and 1595, respectively;
(x) SEQ ID NOs: 1560 and 1596, respectively;
(y) SEQ ID NOs: 1561 and 1597, respectively;
(z) SEQ ID NOs: 1562 and 1598, respectively;
(aa) SEQ ID NOs: 1563 and 1599, respectively;
(bb) SEQ ID NOs: 1564 and 1600, respectively;
(cc) SEQ ID NOs: 1565 and 1601, respectively;
(dd) SEQ ID NOs: 1566 and 1602, respectively;
(ee) SEQ ID NOs: 1567 and 1603, respectively;
(ff) SEQ ID NOs: 1568 and 1604, respectively;
(gg) SEQ ID NOs: 1569 and 1605, respectively; and,
(hh) SEQ ID NOs: 1570 and 1606, respectively.
65. The RNAi oligonucleotide of any one of embodiments 1 to 64, wherein the sense strand comprises a nucleotide sequence as set forth in SEQ ID NO: 1543, wherein the antisense strand comprises a nucleotide sequence as set forth in SEQ ID NO: 1579.
66. The RNAi oligonucleotide of any one of embodiments 1 to 64, wherein the sense strand comprises a nucleotide sequence as set forth in SEQ ID NO: 1560, wherein the antisense strand comprises a nucleotide sequence as set forth in SEQ ID NO: 1596.
67. The RNAi oligonucleotide of any one of embodiments 1 to 64, wherein the sense strand comprises a nucleotide sequence as set forth in SEQ ID NO: 1568, wherein the antisense strand comprises a nucleotide sequence as set forth in SEQ ID NO: 1604.
68. The RNAi oligonucleotide of any one of embodiments 1 to 64, wherein the sense strand comprises a nucleotide sequence as set forth in SEQ ID NO: 1553, wherein the antisense strand comprises a nucleotide sequence as set forth in SEQ ID NO: 1589.
69. The RNAi oligonucleotide of any one of embodiments 1-61, wherein the antisense strand is 22 nucleotides in length.
70. The RNAi oligonucleotide of embodiment 69, wherein the antisense strand comprises a nucleotide sequence selected from SEQ ID NOs: 1579, 1596, 1604, and 1589.
71. The RNAi oligonucleotide of any one of embodiments 1-61 and 69-70, wherein the sense strand comprises a nucleotide sequence selected from SEQ ID NOs: 234, 298, 356, and 376.
72. The RNAi oligonucleotide of any one of embodiments 1-61 and 69-71, wherein the sense strand is 36 nucleotides in length.

73. The RNAi oligonucleotide of embodiment 72, wherein the sense strand comprises a nucleotide sequence selected from SEQ ID NOs: 1543, 1560, 1568, and 1553.

74. An RNAi oligonucleotide for reducing MARC1 expression, the oligonucleotide comprising a sense strand and an antisense strand, wherein the sense strand and the antisense strand form a duplex region, wherein all nucleotides comprising the sense strand and antisense strand are modified, wherein the antisense strand comprises a region of complementarity to a MARC1 mRNA target sequence of any one of SEQ ID NOs: 1-384, and wherein the region of complementarity is at least 15 contiguous nucleotides in length differing by no more than 3 nucleotides from the MARC1 mRNA target sequence.

75. An RNAi oligonucleotide for reducing MARC1 expression, the oligonucleotide comprising a sense strand and an antisense strand, wherein the sense strand and the antisense strand form a duplex region, wherein all nucleotides comprising the sense strand and antisense strand are modified, wherein the 4'-carbon of the sugar of the 5'-nucleotide of the antisense strand comprises a phosphate analog, wherein the antisense strand comprises a region of complementarity to a MARC1 mRNA target sequence of any one of SEQ ID NOs: 1-384, and wherein the region of complementarity is at least 15 contiguous nucleotides in length differing by no more than 3 nucleotides from the MARC1 mRNA target sequence.

76. An RNAi oligonucleotide for reducing MARC1 expression, the oligonucleotide comprising a sense strand and an antisense strand, wherein the sense strand and the antisense strand form a duplex region, wherein all nucleotides comprising the sense strand and antisense strand are modified, wherein the 4'-carbon of the sugar of the 5'-nucleotide of the antisense strand comprises a phosphate analog, wherein the antisense strand comprises a region of complementarity to a MARC1 mRNA target sequence of any one of SEQ ID NOs: 1-384, and wherein the region of complementarity is at least 15 contiguous nucleotides in length differing by no more than 3 nucleotides from the MARC1 mRNA target sequence.

77. An RNAi oligonucleotide for reducing MARC1 expression, the oligonucleotide comprising a sense strand and an antisense strand, wherein the sense strand and the antisense strand form a duplex region, wherein all nucleotides comprising the sense strand and the antisense strand are modified, wherein the antisense strand and the sense strand comprise one or more 2'-fluoro and 2'-O-methyl modified nucleotides and at least one phosphorothioate linkage, wherein the 4'-carbon of the sugar of the 5'-nucleotide of the antisense strand comprises a phosphate analog, wherein the antisense strand comprises a region of complementarity to a MARC1 mRNA target sequence of any one of SEQ ID NOs: 1-384, and wherein the region of complementarity is at least 15 contiguous nucleotides in length differing by no more than 3 nucleotides from the MARC1 mRNA target sequence.

78. The RNAi oligonucleotide of any one of embodiments 1-77, wherein the sense strand comprises a nucleotide sequence of any one of SEQ ID NOs: 1609-1642.

79. The RNAi oligonucleotide of any one of embodiments 1-78, wherein the antisense strand comprises a nucleotide sequence of any one of SEQ ID NOs: 1645-1678.

80. The RNAi oligonucleotide of any one of embodiments 1-79, wherein the sense and antisense strands comprise nucleotide sequences selected from the group consisting of:
(a) SEQ ID NOs: 1609 and 1645, respectively;
(b) SEQ ID NOs: 1610 and 1646, respectively;
(c) SEQ ID NOs: 1611 and 1647, respectively;
(d) SEQ ID NOs: 1612 and 1648, respectively;
(e) SEQ ID NOs: 1613 and 1649, respectively;
(f) SEQ ID NOs: 1614 and 1650, respectively;
(g) SEQ ID NOs: 1615 and 1651, respectively;
(h) SEQ ID NOs: 1616 and 1652, respectively;
(i) SEQ ID NOs: 1617 and 1653, respectively;
(j) SEQ ID NOs: 1618 and 1654, respectively;
(k) SEQ ID NOs: 1619 and 1655, respectively;
(l) SEQ ID NOs: 1620 and 1656, respectively;
(m) SEQ ID NOs: 1621 and 1657, respectively;
(n) SEQ ID NOs: 1622 and 1658, respectively;
(o) SEQ ID NOs: 1623 and 1659, respectively;
(p) SEQ ID NOs: 1624 and 1660, respectively;
(q) SEQ ID NOs: 1625 and 1661, respectively;
(r) SEQ ID NOs: 1626 and 1662, respectively;
(s) SEQ ID NOs: 1627 and 1663, respectively;
(t) SEQ ID NOs: 1628 and 1664, respectively;
(u) SEQ ID NOs: 1628 and 1665, respectively;
(v) SEQ ID NOs: 1630 and 1666, respectively;
(w) SEQ ID NOs: 1631 and 1667, respectively;
(x) SEQ ID NOs: 1632 and 1668, respectively;
(y) SEQ ID NOs: 1633 and 1669, respectively;
(z) SEQ ID NOs: 1634 and 1670, respectively;
(aa) SEQ ID NOs: 1635 and 1671, respectively;
(bb) SEQ ID NOs: 1636 and 1672, respectively;
(cc) SEQ ID NOs: 1637 and 1673, respectively;
(dd) SEQ ID NOs: 1638 and 1674, respectively;
(ee) SEQ ID NOs: 1639 and 1675, respectively;
(ff) SEQ ID NOs: 1640 and 1676, respectively;
(gg) SEQ ID NOs: 1641 and 1677, respectively; and,
(hh) SEQ ID NOs: 1642 and 1678, respectively.

81. The RNAi oligonucleotide of any one of embodiments 1-80, wherein the sense and antisense strands comprise the nucleotide sequences set forth in SEQ ID NOs: 1615 and 1651, respectively.

82. The RNAi oligonucleotide of any one of embodiments 1-80, wherein the sense and antisense strands comprise the nucleotide sequences set forth in SEQ ID NOs: 1632 and 1668, respectively.

83. The RNAi oligonucleotide of any one of embodiments 1-80, wherein the sense and antisense strands comprise the nucleotide sequences set forth in SEQ ID NOs: 1640 and 1676, respectively.

84. The RNAi oligonucleotide of any one of embodiments 1-80, wherein the sense and antisense strands comprise the nucleotide sequences set forth in SEQ ID NOs: 1625 and 1661, respectively.

85. An RNAi oligonucleotide for inhibiting expression of MARC1, wherein said dsRNA comprises a sense strand and an antisense strand, the antisense strand comprising a region of complementarity to a MARC1 RNA transcript, wherein the sense strand comprises the sequence and all of the modifications of 5'-mGs-mG-mC-mU-mA-mG-mA-fG-fA-fA-fG-mA-mA-mA-mG-mU-mU-mA-mA-mA-mG-mC-mA-mG-mC-mC-mG-[ademA-GalNAc]-[ademA-GalNAc]-[ademA-GalNAc]-mG-mG-mC-mU-mG-mC-3' (SEQ ID NO: 1615), and wherein the antisense strand comprises the sequence and all of the modifications of 5'-MePhosphonate-40-mUs-fUs-fUs-fA-fA-mC-fU-mU-mU-fC-mU-mU-mC-fU-mC-mU-mA-mG-mC-mCs-mGs-mG-3' (SEQ ID NO: 1651), wherein mC, mA, mG, and mU=2'-OMe ribonucleosides; fA, fC, fG, and fU=2'F ribonucleosides; s=phosphorothioate, and wherein ademA-GalNAc=

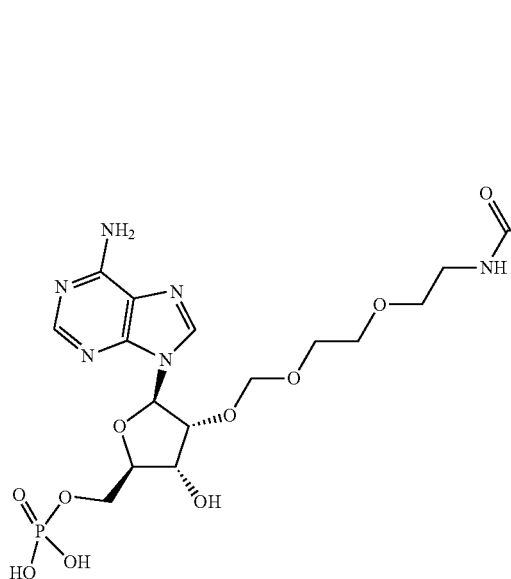

86. An RNAi oligonucleotide for inhibiting expression of MARC1, wherein said dsRNA comprises a sense strand and an antisense strand, the antisense strand comprising a region of complementarity to a MARC1 RNA transcript, wherein the sense strand comprises the sequence and all of the modifications of 5'-mAs-mG-mA-mA-mC-mG-mA-fA-fA-fG-fU mU-mA-mU-mA-mU-mG-mG-mA-mA-mG-mC-mA-mG-mC-mC-mG-[ademA-GalNAc]-[ademA-Gal-NAc]-[ademA-GalNAc]-mG-mG-mC-mU-mG-mC-3' (SEQ ID NO: 1632), and wherein the antisense strand comprises the sequence and all of the modifications of 5'-MePhosphonate-40-mUs-fUs-fC s-fC-fA-mU-fA-mU-mA-fA-mC-mU-mU-fU-mC-mG-mU-mU-mC-mUs-mGs-mG-3' (SEQ ID NO: 1668), wherein mC, mA, mG, and mU=2'-OMe ribonucleosides; fA, fC, fG, and fU=2'F ribo- nucleosides; s=phosphorothioate, and wherein ademA-Gal-NAc=

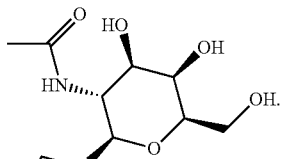

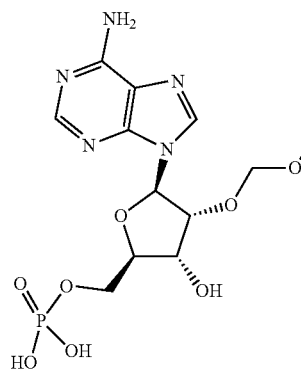

87. An RNAi oligonucleotide for inhibiting expression of MARC1, wherein said dsRNA comprises a sense strand and an antisense strand, the antisense strand comprising a region of complementarity to a MARC1 RNA transcript, wherein the sense strand comprises the sequence and all of the modifications of 5'-mAs-mA-mG-mU-mU-mG-mA-fC-fU-fA-fA-mA-mC-mU-mU-mG-mA-mA-mA-mA-mG-mC-mA-mG-mC-mC-mC-mG-[ademA-GalNAc]-[ademA-Gal-NAc]-[ademA-GalNAc]-mG-mG-mC-mU-mG-mC-3' (SEQ ID NO: 1640), and wherein the antisense strand comprises the sequence and all of the modifications of 5'-MePhosphonate-40-mUs-fUs-fUs-fU-fC-mA-fA-mG-mU-fU-mU-mA-mG-fU-mC-mA-mA-mC-mU-mUs-mGs-mG-3' (SEQ ID NO: 1676), wherein mC, mA, mG, and mU=2'-OMe ribonucleosides; fA, fC, fG, and fU=2'F ribonucleosides; s=phosphorothioate, and wherein ademA-GalNAc=

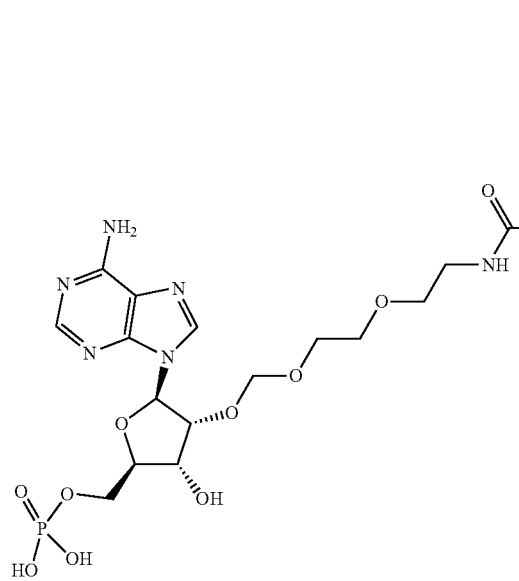

88. A double stranded RNAi oligonucleotide (dsRNAi) for inhibiting expression of MARC1, wherein said dsRNA comprises a sense strand and an antisense strand, the antisense strand comprising a region of complementarity to a MARC1 RNA transcript, wherein the sense strand comprises the sequence and all of the modifications of 5'-mUs-mG-mU-mG-mA-mA-mU-fA-fA-fA-fU-mG-mG-mA-mA-mG-mC-mU-mA-mA-mG-mC-mA-mG-mC-mC-mG-[ademA-GalNAc]-[ademA-GalNAc]-[ademA-GalNAc]-mG-mG-mC-mU-mG-mC-3' (SEQ ID NO: 1625), and wherein the antisense strand comprises the sequence and all of the modifications of 5'-MePhosphonate-40-mUs-fUs-fAs-fG-fC-mU-fU-mC-mC-fA-mU-mU-mU-fA-mU-mU-mC-mA-mC-mAs-mGs-mG-3' (SEQ ID NO: 1661), wherein mC, mA, mG, and mU=2'-OMe ribonucleosides; fA, fC, fG, and fU=2'F ribonucleosides; s=phosphorothioate, and wherein ademA-GalNAc=

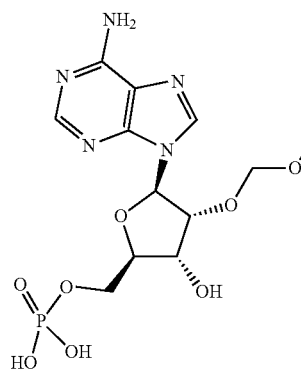

89. The RNAi oligonucleotide of any one of embodiments 1-88, wherein the oligonucleotide is a Dicer substrate.
90. The RNAi oligonucleotide of any one of embodiments 1-88, wherein the oligonucleotide is a Dicer substrate that, upon endogenous Dicer processing, yields double-stranded nucleic acids of 19-23 nucleotides in length capable of reducing MARC1 expression in a mammalian cell.
91. A method for treating a subject having a disease, disorder or condition associated with MARC1 expression, the method comprising administering to the subject a therapeutically effective amount of the RNAi oligonucleotide of any one of the preceding embodiments, or pharmaceutical composition thereof, thereby treating the subject.

92. A pharmaceutical composition comprising the RNAi oligonucleotide of any one of embodiments 1 to 90, and a pharmaceutically acceptable carrier, delivery agent or excipient.

93. A method of delivering an oligonucleotide to a subject, the method comprising administering pharmaceutical composition of embodiment 92 to the subject.

94. A method for reducing MARC1 expression in a cell, a population of cells or a subject, the method comprising the step of:
   i. contacting the cell or the population of cells with the RNAi oligonucleotide of any one of embodiments 1 to 90, or the pharmaceutical composition of embodiment 92; or
   ii. administering to the subject the RNAi oligonucleotide of any one of embodiments 1 to 90, or the pharmaceutical composition of embodiment 92.

95. The method of embodiment 94, wherein reducing MARC1 expression comprises reducing an amount or level of MARC1 mRNA, an amount or level of MARC1 protein, or both.

96. The method of embodiment 94 or 95, wherein the subject has a disease, disorder or condition associated with MARC1 expression, for example MARC1 expression in the liver.

97. The method of embodiment 96, wherein the subject has a disease, disorder or condition associated with MARC1 expression in the liver.

98. The method of embodiment 97, wherein the subject has a disease, disorder or condition associated with MARC1 expression in hepatocytes.

99. The method of embodiment 91 or 96 to 98, wherein the disease, disorder or condition associated with MARC1 expression is non-alcoholic fatty liver disease (NAFLD), non-alcoholic steatohepatitis (NASH), and alcoholic steatohepatitis (ASH).

100. The method of any one of embodiments 91 and 94 to 99, wherein the RNAi oligonucleotide, or pharmaceutical composition, is administered in combination with a second composition or therapeutic agent.

101. A method for treating a subject having a disease, disorder or condition associated with MARC1 expression, the method comprising administering to the subject a therapeutically effective amount of an RNAi oligonucleotide comprising a sense strand and an antisense strand, wherein the sense strand and the antisense strand form a duplex region, wherein the antisense strand comprises a region of complementarity to a MARC1 mRNA target sequence of any one of SEQ ID NOs: 1-384, and wherein the region of complementarity is at least 15 contiguous nucleotides in length differing by no more than 3 nucleotides from the MARC1 mRNA target sequence.

102. A method for treating a subject having a disease, disorder or condition associated with MARC1 expression, the method comprising administering to the subject a therapeutically effective amount of an RNAi oligonucleotide comprising a sense strand and an antisense strand selected from a row set forth in Table 4 or Table 6, or pharmaceutical composition thereof, thereby treating the subject.

103. A method for treating a subject having a disease, disorder or condition associated with MARC1 expression, the method comprising administering to the subject a therapeutically effective amount of an RNAi oligonucleotide comprising a sense strand and an antisense strand, wherein the sense strand and antisense strands comprise nucleotide sequences selected from the group consisting of:
(a) SEQ ID NOs: 1537 and 1573, respectively;
(b) SEQ ID NOs: 1538 and 1574, respectively;
(c) SEQ ID NOs: 1539 and 1575, respectively;
(d) SEQ ID NOs: 1540 and 1576, respectively;
(e) SEQ ID NOs: 1541 and 1577, respectively;
(f) SEQ ID NOs: 1542 and 1578, respectively;
(g) SEQ ID NOs: 1543 and 1579, respectively;
(h) SEQ ID NOs: 1544 and 1580, respectively;
(i) SEQ ID NOs: 1545 and 1581, respectively;
(j) SEQ ID NOs: 1546 and 1582, respectively;
(k) SEQ ID NOs: 1547 and 1583, respectively;
(l) SEQ ID NOs: 1548 and 1584, respectively;
(m) SEQ ID NOs: 1549 and 1585, respectively;
(n) SEQ ID NOs: 1550 and 1586, respectively;
(o) SEQ ID NOs: 1551 and 1587, respectively;
(p) SEQ ID NOs: 1552 and 1588, respectively;
(q) SEQ ID NOs: 1553 and 1589, respectively;
(r) SEQ ID NOs: 1554 and 1590, respectively;
(s) SEQ ID NOs: 1555 and 1591, respectively;
(t) SEQ ID NOs: 1556 and 1592, respectively;
(u) SEQ ID NOs: 1557 and 1593, respectively;
(v) SEQ ID NOs: 1558 and 1594, respectively;
(w) SEQ ID NOs: 1559 and 1595, respectively;
(x) SEQ ID NOs: 1560 and 1596, respectively;
(y) SEQ ID NOs: 1561 and 1597, respectively;
(z) SEQ ID NOs: 1562 and 1598, respectively;
(aa) SEQ ID NOs: 1563 and 1599, respectively;
(bb) SEQ ID NOs: 1564 and 1600, respectively;
(cc) SEQ ID NOs: 1565 and 1601, respectively;
(dd) SEQ ID NOs: 1566 and 1602, respectively;
(ee) SEQ ID NOs: 1567 and 1603, respectively;
(ff) SEQ ID NOs: 1568 and 1604, respectively;
(gg) SEQ ID NOs: 1569 and 1605, respectively; and,
(hh) SEQ ID NOs: 1570 and 1606, respectively.

104. The method of embodiment 103, wherein the sense strand comprises a nucleotide sequence as set forth in SEQ ID NO: 1543, wherein the antisense strand comprises a nucleotide sequence as set forth in SEQ ID NO: 1579.

105. The method of embodiment 103, wherein the sense strand comprises a nucleotide sequence as set forth in SEQ ID NO: 1560, wherein the antisense strand comprises a nucleotide sequence as set forth in SEQ ID NO: 1596.

106. The method of embodiment 103, wherein the sense strand comprises a nucleotide sequence as set forth in SEQ ID NO: 1568, wherein the antisense strand comprises a nucleotide sequence as set forth in SEQ ID NO: 1604.

107. The method of embodiment 103, wherein the sense strand comprises a nucleotide sequence as set forth in SEQ ID NO: 1553, wherein the antisense strand comprises a nucleotide sequence as set forth in SEQ ID NO: 1589.

108. A method for treating a subject having a disease, disorder or condition associated with MARC1 expression, the method comprising administering to the subject a therapeutically effective amount of an RNAi oligonucleotide comprising a sense strand and an antisense strand, wherein the sense strand and antisense strands comprise nucleotide sequences selected from the group consisting of:
(a) SEQ ID NOs: 1609 and 1645, respectively;
(b) SEQ ID NOs: 1610 and 1646, respectively;
(c) SEQ ID NOs: 1611 and 1647, respectively;
(d) SEQ ID NOs: 1612 and 1648, respectively;
(e) SEQ ID NOs: 1613 and 1649, respectively;
(f) SEQ ID NOs: 1614 and 1650, respectively;
(g) SEQ ID NOs: 1615 and 1651, respectively;
(h) SEQ ID NOs: 1616 and 1652, respectively;

(i) SEQ ID NOs: 1617 and 1653, respectively;
(j) SEQ ID NOs: 1618 and 1654, respectively;
(k) SEQ ID NOs: 1619 and 1655, respectively;
(l) SEQ ID NOs: 1620 and 1656, respectively;
(m) SEQ ID NOs: 1621 and 1657, respectively;
(n) SEQ ID NOs: 1622 and 1658, respectively;
(o) SEQ ID NOs: 1623 and 1659, respectively;
(p) SEQ ID NOs: 1624 and 1660, respectively;
(q) SEQ ID NOs: 1625 and 1661, respectively;
(r) SEQ ID NOs: 1626 and 1662, respectively;
(s) SEQ ID NOs: 1627 and 1663, respectively;
(t) SEQ ID NOs: 1628 and 1664, respectively;
(u) SEQ ID NOs: 1628 and 1665, respectively;
(v) SEQ ID NOs: 1630 and 1666, respectively;
(w) SEQ ID NOs: 1631 and 1667, respectively;
(x) SEQ ID NOs: 1632 and 1668, respectively;
(y) SEQ ID NOs: 1633 and 1669, respectively;
(z) SEQ ID NOs: 1634 and 1670, respectively;
(aa) SEQ ID NOs: 1635 and 1671, respectively;
(bb) SEQ ID NOs: 1636 and 1672, respectively;
(cc) SEQ ID NOs: 1637 and 1673, respectively;
(dd) SEQ ID NOs: 1638 and 1674, respectively;
(ee) SEQ ID NOs: 1639 and 1675, respectively;
(ff) SEQ ID NOs: 1640 and 1676, respectively;
(gg) SEQ ID NOs: 1641 and 1677, respectively; and,
(hh) SEQ ID NOs: 1642 and 1678, respectively.

109. The method of embodiment 108, wherein the sense strand comprises a nucleotide sequence as set forth in SEQ ID NO: 1615, wherein the antisense strand comprises a nucleotide sequence as set forth in SEQ ID NO: 1651.

110. The method of embodiment 108, wherein the sense strand comprises a nucleotide sequence as set forth in SEQ ID NO: 1632, wherein the antisense strand comprises a nucleotide sequence as set forth in SEQ ID NO: 1668.

111. The method of embodiment 108, wherein the sense strand comprises a nucleotide sequence as set forth in SEQ ID NO: 1640, wherein the antisense strand comprises a nucleotide sequence as set forth in SEQ ID NO: 1676.

112. The method of embodiment 108, wherein the sense strand comprises a nucleotide sequence as set forth in SEQ ID NO: 1625, wherein the antisense strand comprises a nucleotide sequence as set forth in SEQ ID NO: 1661.

113. The method of any one of embodiments 101 to 112, wherein the disease, disorder or condition associated with MARC1 expression is non-alcoholic fatty liver disease (NAFLD), non-alcoholic steatohepatitis (NASH), or alcoholic steatohepatitis (ASH).

114. Use of the RNAi oligonucleotide of any one of embodiments 1 to 90, or the pharmaceutical composition of embodiment 92, in the manufacture of a medicament for the treatment of a disease, disorder or condition associated with MARC1 expression, optionally for the treatment of non-alcoholic fatty liver disease (NAFLD), non-alcoholic steatohepatitis (NASH), or alcoholic steatohepatitis (ASH).

115. The RNAi oligonucleotide of any one of embodiments 1 to 90, or the pharmaceutical composition of embodiment 92, for use, or adaptable for use, in the treatment of a disease, disorder or condition associated with MARC1 expression, optionally for the treatment of non-alcoholic fatty liver disease (NAFLD), non-alcoholic steatohepatitis (NASH), or alcoholic steatohepatitis (ASH).

116. The RNAi oligonucleotide of any one of embodiments 1 to 90, or the pharmaceutical composition of embodiment 92, for use, or adaptable for use, in the treatment of a disease, disorder or condition associated with MARC1 expression in the liver, for the treatment of non-alcoholic fatty liver disease (NAFLD), non-alcoholic steatohepatitis (NASH), or alcoholic steatohepatitis (ASH).

117. A kit comprising the RNAi oligonucleotide of any one of embodiments 1 to 90, an optional pharmaceutically acceptable carrier, and a package insert comprising instructions for administration to a subject having a disease, disorder or condition associated with MARC1 expression.

118. The use of embodiment 114, the RNAi oligonucleotide or pharmaceutical composition for use, or adaptable for use, of embodiment 115, or the kit of embodiment 116, wherein the disease, disorder or condition associated with MARC1 expression is non-alcoholic fatty liver disease (NAFLD), non-alcoholic steatohepatitis (NASH), or alcoholic steatohepatitis (ASH).

SEQUENCE LISTING (1696 sequences)

SEQ ID NO: 1 - RNA, 19 nt, Artificial Sequence
  Description of Artificial Sequence: Synthetic oligonucleotide
gcgcagcucuggaucuacc

SEQ ID NO: 2 - RNA, 19 nt, Artificial Sequence
  Description of Artificial Sequence: Synthetic oligonucleotide
gcagcucuggaucuacccu

SEQ ID NO: 3 - RNA, 19 nt, Artificial Sequence
  Description of Artificial Sequence: Synthetic oligonucleotide
cagcucuggaucuacccug

SEQ ID NO: 4 - RNA, 19 nt, Artificial Sequence
  Description of Artificial Sequence: Synthetic oligonucleotide
agcucuggaucuacccugu

SEQ ID NO: 5 - RNA, 19 nt, Artificial Sequence
  Description of Artificial Sequence: Synthetic oligonucleotide
gcucuggaucuacccugug

SEQ ID NO: 6 - RNA, 19 nt, Artificial Sequence
  Description of Artificial Sequence: Synthetic oligonucleotide
cucuggaucuacccuguga

SEQ ID NO: 7 - RNA, 19 nt, Artificial Sequence
  Description of Artificial Sequence: Synthetic oligonucleotide
ucuggaucuacccugugaa

SEQ ID NO: 8 - RNA, 19 nt, Artificial Sequence
  Description of Artificial Sequence: Synthetic oligonucleotide
cuggaucuacccugugaaa

SEQ ID NO: 9 - RNA, 19 nt, Artificial Sequence
  Description of Artificial Sequence: Synthetic oligonucleotide
uggaucuacccugugaaau

SEQ ID NO: 10 - RNA, 19 nt, Artificial Sequence
  Description of Artificial Sequence: Synthetic oligonucleotide
ggaucuacccugugaaauc

SEQ ID NO: 11 - RNA, 19 nt, Artificial Sequence
  Description of Artificial Sequence: Synthetic oligonucleotide
gaucuacccugugaaaucc

SEQ ID NO: 12 - RNA, 19 nt, Artificial Sequence
  Description of Artificial Sequence: Synthetic oligonucleotide
aucuacccugugaaauccu

SEQ ID NO: 13 - RNA, 19 nt, Artificial Sequence
  Description of Artificial Sequence: Synthetic oligonucleotide
ucuacccugugaaauccug

SEQ ID NO: 14 - RNA, 19 nt, Artificial Sequence
  Description of Artificial Sequence: Synthetic oligonucleotide
cuacccugugaaauccugc

SEQ ID NO: 15 - RNA, 19 nt, Artificial Sequence
  Description of Artificial Sequence: Synthetic oligonucleotide
acccugugaaauccugcaa

SEQ ID NO: 16 - RNA, 19 nt, Artificial Sequence
  Description of Artificial Sequence: Synthetic oligonucleotide
cccugugaaauccugcaag

SEQ ID NO: 17 - RNA, 19 nt, Artificial Sequence
  Description of Artificial Sequence: Synthetic oligonucleotide
ccugugaaauccugcaagg

SEQ ID NO: 18 - RNA, 19 nt, Artificial Sequence
  Description of Artificial Sequence: Synthetic oligonucleotide
ugaaauccugcaagggggu

SEQ ID NO: 19 - RNA, 19 nt, Artificial Sequence
  Description of Artificial Sequence: Synthetic oligonucleotide
aaauccugcaagggggugc

SEQ ID NO: 20 - RNA, 19 nt, Artificial Sequence
  Description of Artificial Sequence: Synthetic oligonucleotide
aaccugcgggacagguuuu

SEQ ID NO: 21 - RNA, 19 nt, Artificial Sequence
  Description of Artificial Sequence: Synthetic oligonucleotide
accugcgggacagguuuug

SEQ ID NO: 22 - RNA, 19 nt, Artificial Sequence
  Description of Artificial Sequence: Synthetic oligonucleotide
ccugcgggacagguuuugg

SEQ ID NO: 23 - RNA, 19 nt, Artificial Sequence
  Description of Artificial Sequence: Synthetic oligonucleotide
cugcgggacagguuuuggc

SEQ ID NO: 24 - RNA, 19 nt, Artificial Sequence
  Description of Artificial Sequence: Synthetic oligonucleotide
gcgggacagguuuuggcuu

SEQ ID NO: 25 - RNA, 19 nt, Artificial Sequence
  Description of Artificial Sequence: Synthetic oligonucleotide
cgggacagguuuuggcuug

SEQ ID NO: 26 - RNA, 19 nt, Artificial Sequence
  Description of Artificial Sequence: Synthetic oligonucleotide
gggacagguuuuggcuugu

SEQ ID NO: 27 - RNA, 19 nt, Artificial Sequence
  Description of Artificial Sequence: Synthetic oligonucleotide
ggacagguuuuggcuugug

SEQ ID NO: 28 - RNA, 19 nt, Artificial Sequence
  Description of Artificial Sequence: Synthetic oligonucleotide
gacagguuuuggcuuguga

SEQ ID NO: 29 - RNA, 19 nt, Artificial Sequence
  Description of Artificial Sequence: Synthetic oligonucleotide
acagguuuuggcuugugau

SEQ ID NO: 30 - RNA, 19 nt, Artificial Sequence
  Description of Artificial Sequence: Synthetic oligonucleotide
cagguuuuggcuugugauc

SEQ ID NO: 31 - RNA, 19 nt, Artificial Sequence
  Description of Artificial Sequence: Synthetic oligonucleotide
agguuuuggcuugugauca

SEQ ID NO: 32 - RNA, 19 nt, Artificial Sequence
  Description of Artificial Sequence: Synthetic oligonucleotide
gguuuuggcuugugaucaa

SEQ ID NO: 33 - RNA, 19 nt, Artificial Sequence
  Description of Artificial Sequence: Synthetic oligonucleotide
guuuuggcuugugaucaac

SEQ ID NO: 34 - RNA, 19 nt, Artificial Sequence
  Description of Artificial Sequence: Synthetic oligonucleotide
uuuggcuugugaucaacca

SEQ ID NO: 35 - RNA, 19 nt, Artificial Sequence
  Description of Artificial Sequence: Synthetic oligonucleotide
uuggcuugugaucaaccag

SEQ ID NO: 36 - RNA, 19 nt, Artificial Sequence
  Description of Artificial Sequence: Synthetic oligonucleotide
ggcuugugaucaaccagga

SEQ ID NO: 37 - RNA, 19 nt, Artificial Sequence
  Description of Artificial Sequence: Synthetic oligonucleotide
gcuugugaucaaccaggag

SEQ ID NO: 38 - RNA, 19 nt, Artificial Sequence
  Description of Artificial Sequence: Synthetic oligonucleotide
cuugugaucaaccaggagg

SEQ ID NO: 39 - RNA, 19 nt, Artificial Sequence
  Description of Artificial Sequence: Synthetic oligonucleotide
uugugaucaaccaggaggg

SEQ ID NO: 40 - RNA, 19 nt, Artificial Sequence
  Description of Artificial Sequence: Synthetic oligonucleotide
ugugaucaaccaggaggga

SEQ ID NO: 41 - RNA, 19 nt, Artificial Sequence
  Description of Artificial Sequence: Synthetic oligonucleotide
gugaucaaccaggagggaa

SEQ ID NO: 42 - RNA, 19 nt, Artificial Sequence
  Description of Artificial Sequence: Synthetic oligonucleotide
ugaucaaccaggagggaaa

SEQ ID NO: 43 - RNA, 19 nt, Artificial Sequence
  Description of Artificial Sequence: Synthetic oligonucleotide
aucaaccaggagggaaaca

SEQ ID NO: 44 - RNA, 19 nt, Artificial Sequence
  Description of Artificial Sequence: Synthetic oligonucleotide
ucaaccaggagggaaacau

SEQ ID NO: 45 - RNA, 19 nt, Artificial Sequence
  Description of Artificial Sequence: Synthetic oligonucleotide
caaccaggagggaaacaug

SEQ ID NO: 46 - RNA, 19 nt, Artificial Sequence
  Description of Artificial Sequence: Synthetic oligonucleotide
aaccaggagggaaacaugg

SEQ ID NO: 47 - RNA, 19 nt, Artificial Sequence
  Description of Artificial Sequence: Synthetic oligonucleotide
accaggagggaaacauggu

SEQ ID NO: 48 - RNA, 19 nt, Artificial Sequence
  Description of Artificial Sequence: Synthetic oligonucleotide
ccaggagggaaacaugguu

SEQ ID NO: 49 - RNA, 19 nt, Artificial Sequence
  Description of Artificial Sequence: Synthetic oligonucleotide
caggagggaaacaugguua

SEQ ID NO: 50 - RNA, 19 nt, Artificial Sequence
  Description of Artificial Sequence: Synthetic oligonucleotide
aggagggaaacaugguuac

SEQ ID NO: 51 - RNA, 19 nt, Artificial Sequence
  Description of Artificial Sequence: Synthetic oligonucleotide
ggagggaaacaugguuacu

SEQ ID NO: 52 - RNA, 19 nt, Artificial Sequence
  Description of Artificial Sequence: Synthetic oligonucleotide
gagggaaacaugguuacug

SEQ ID NO: 53 - RNA, 19 nt, Artificial Sequence
  Description of Artificial Sequence: Synthetic oligonucleotide
gggaaacaugguuacugcu

SEQ ID NO: 54 - RNA, 19 nt, Artificial Sequence
  Description of Artificial Sequence: Synthetic oligonucleotide
ggaaacaugguuacugcuc

SEQ ID NO: 55 - RNA, 19 nt, Artificial Sequence
  Description of Artificial Sequence: Synthetic oligonucleotide
gaaacaugguuacugcucg

SEQ ID NO: 56 - RNA, 19 nt, Artificial Sequence
  Description of Artificial Sequence: Synthetic oligonucleotide
aaacaugguuacugcucgc

SEQ ID NO: 57 - RNA, 19 nt, Artificial Sequence
  Description of Artificial Sequence: Synthetic oligonucleotide
aacaugguuacugcucgcc

SEQ ID NO: 58 - RNA, 19 nt, Artificial Sequence
  Description of Artificial Sequence: Synthetic oligonucleotide
acaugguuacugcucgcca

SEQ ID NO: 59 - RNA, 19 nt, Artificial Sequence
  Description of Artificial Sequence: Synthetic oligonucleotide
caugguuacugcucgccag

SEQ ID NO: 60 - RNA, 19 nt, Artificial Sequence
  Description of Artificial Sequence: Synthetic oligonucleotide
gguuacugcucgccaggaa

SEQ ID NO: 61 - RNA, 19 nt, Artificial Sequence
  Description of Artificial Sequence: Synthetic oligonucleotide
gccaggaaccucgccuggu

SEQ ID NO: 62 - RNA, 19 nt, Artificial Sequence
  Description of Artificial Sequence: Synthetic oligonucleotide
aggaaccucgccugguccu

SEQ ID NO: 63 - RNA, 19 nt, Artificial Sequence
  Description of Artificial Sequence: Synthetic oligonucleotide
ccucgccugguccugauuu

SEQ ID NO: 64 - RNA, 19 nt, Artificial Sequence
  Description of Artificial Sequence: Synthetic oligonucleotide
cucgccugguccugauuuc

SEQ ID NO: 65 - RNA, 19 nt, Artificial Sequence
  Description of Artificial Sequence: Synthetic oligonucleotide
gccugguccugauuucccu

SEQ ID NO: 66 - RNA, 19 nt, Artificial Sequence
  Description of Artificial Sequence: Synthetic oligonucleotide
cugguccugauuucccuga

SEQ ID NO: 67 - RNA, 19 nt, Artificial Sequence
  Description of Artificial Sequence: Synthetic oligonucleotide
ugguccugauuucccugac

SEQ ID NO: 68 - RNA, 19 nt, Artificial Sequence
  Description of Artificial Sequence: Synthetic oligonucleotide
guccugauuucccugaccu

SEQ ID NO: 69 - RNA, 19 nt, Artificial Sequence
  Description of Artificial Sequence: Synthetic oligonucleotide
ccugauuucccugaccugc

SEQ ID NO: 70 - RNA, 19 nt, Artificial Sequence
  Description of Artificial Sequence: Synthetic oligonucleotide
cugaccugcgauggugaca

SEQ ID NO: 71 - RNA, 19 nt, Artificial Sequence
  Description of Artificial Sequence: Synthetic oligonucleotide
ccugcgauggugacacccu

SEQ ID NO: 72 - RNA, 19 nt, Artificial Sequence
  Description of Artificial Sequence: Synthetic oligonucleotide
ugcgauggugacacccuga

SEQ ID NO: 73 - RNA, 19 nt, Artificial Sequence
  Description of Artificial Sequence: Synthetic oligonucleotide
gcgauggugacacccugac

SEQ ID NO: 74 - RNA, 19 nt, Artificial Sequence
  Description of Artificial Sequence: Synthetic oligonucleotide
cgauggugacacccugacu

SEQ ID NO: 75 - RNA, 19 nt, Artificial Sequence
  Description of Artificial Sequence: Synthetic oligonucleotide
gauggugacacccugacuc

SEQ ID NO: 76 - RNA, 19 nt, Artificial Sequence
  Description of Artificial Sequence: Synthetic oligonucleotide
auggugacacccugacucu

SEQ ID NO: 77 - RNA, 19 nt, Artificial Sequence
  Description of Artificial Sequence: Synthetic oligonucleotide
uggugacacccugacucuc

SEQ ID NO: 78 - RNA, 19 nt, Artificial Sequence
  Description of Artificial Sequence: Synthetic oligonucleotide
ggugacacccugacucuca

SEQ ID NO: 79 - RNA, 19 nt, Artificial Sequence
  Description of Artificial Sequence: Synthetic oligonucleotide
gugacacccugacucucag

SEQ ID NO: 80 - RNA, 19 nt, Artificial Sequence
  Description of Artificial Sequence: Synthetic oligonucleotide
ugacacccugacucucagu

SEQ ID NO: 81 - RNA, 19 nt, Artificial Sequence
  Description of Artificial Sequence: Synthetic oligonucleotide
gacacccugacucucagug

SEQ ID NO: 82 - RNA, 19 nt, Artificial Sequence
  Description of Artificial Sequence: Synthetic oligonucleotide
acacccugacucucagugc

SEQ ID NO: 83 - RNA, 19 nt, Artificial Sequence
  Description of Artificial Sequence: Synthetic oligonucleotide
cacccugacucucagugca

SEQ ID NO: 84 - RNA, 19 nt, Artificial Sequence
  Description of Artificial Sequence: Synthetic oligonucleotide
acccugacucucagugcag

SEQ ID NO: 85 - RNA, 19 nt, Artificial Sequence
  Description of Artificial Sequence: Synthetic oligonucleotide
cccugacucucagugcagc

SEQ ID NO: 86 - RNA, 19 nt, Artificial Sequence
  Description of Artificial Sequence: Synthetic oligonucleotide
ccugacucucagugcagcc

SEQ ID NO: 87 - RNA, 19 nt, Artificial Sequence
  Description of Artificial Sequence: Synthetic oligonucleotide
cugacucucagugcagccu

SEQ ID NO: 88 - RNA, 19 nt, Artificial Sequence
  Description of Artificial Sequence: Synthetic oligonucleotide
ugacucucagugcagccua

SEQ ID NO: 89 - RNA, 19 nt, Artificial Sequence
  Description of Artificial Sequence: Synthetic oligonucleotide
gacucucagugcagccuac

SEQ ID NO: 90 - RNA, 19 nt, Artificial Sequence
  Description of Artificial Sequence: Synthetic oligonucleotide
acucucagugcagccuaca

SEQ ID NO: 91 - RNA, 19 nt, Artificial Sequence
  Description of Artificial Sequence: Synthetic oligonucleotide
cucucagugcagccuacac

SEQ ID NO: 92 - RNA, 19 nt, Artificial Sequence
  Description of Artificial Sequence: Synthetic oligonucleotide
ucucagugcagccuacaca

SEQ ID NO: 93 - RNA, 19 nt, Artificial Sequence
  Description of Artificial Sequence: Synthetic oligonucleotide
ucagugcagccuacacaaa

SEQ ID NO: 94 - RNA, 19 nt, Artificial Sequence
  Description of Artificial Sequence: Synthetic oligonucleotide
cagugcagccuacacaaag

SEQ ID NO: 95 - RNA, 19 nt, Artificial Sequence
  Description of Artificial Sequence: Synthetic oligonucleotide
agugcagccuacacaaagg

SEQ ID NO: 96 - RNA, 19 nt, Artificial Sequence
  Description of Artificial Sequence: Synthetic oligonucleotide
gugcagccuacacaaagga

SEQ ID NO: 97 - RNA, 19 nt, Artificial Sequence
  Description of Artificial Sequence: Synthetic oligonucleotide
ugcagccuacacaaaggac

SEQ ID NO: 98 - RNA, 19 nt, Artificial Sequence
  Description of Artificial Sequence: Synthetic oligonucleotide
gcagccuacacaaaggacc

SEQ ID NO: 99 - RNA, 19 nt, Artificial Sequence
  Description of Artificial Sequence: Synthetic oligonucleotide
cagccuacacaaaggaccu

SEQ ID NO: 100 - RNA, 19 nt, Artificial Sequence
  Description of Artificial Sequence: Synthetic oligonucleotide
agccuacacaaaggaccua

SEQ ID NO: 101 - RNA, 19 nt, Artificial Sequence
  Description of Artificial Sequence: Synthetic oligonucleotide
gccuacacaaaggaccuac

SEQ ID NO: 102 - RNA, 19 nt, Artificial Sequence
  Description of Artificial Sequence: Synthetic oligonucleotide
acacaaaggaccuacuacu

SEQ ID NO: 103 - RNA, 19 nt, Artificial Sequence
  Description of Artificial Sequence: Synthetic oligonucleotide
cacaaaggaccuacuacug

SEQ ID NO: 104 - RNA, 19 nt, Artificial Sequence
  Description of Artificial Sequence: Synthetic oligonucleotide
acaaaggaccuacuacugc

SEQ ID NO: 105 - RNA, 19 nt, Artificial Sequence
  Description of Artificial Sequence: Synthetic oligonucleotide
caaaggaccuacuacugcc

SEQ ID NO: 106 - RNA, 19 nt, Artificial Sequence
  Description of Artificial Sequence: Synthetic oligonucleotide
aaaggaccuacuacugccu

SEQ ID NO: 107 - RNA, 19 nt, Artificial Sequence
  Description of Artificial Sequence: Synthetic oligonucleotide
aaggaccuacuacugccua

SEQ ID NO: 108 - RNA, 19 nt, Artificial Sequence
  Description of Artificial Sequence: Synthetic oligonucleotide
aggaccuacuacugccuau

SEQ ID NO: 109 - RNA, 19 nt, Artificial Sequence
  Description of Artificial Sequence: Synthetic oligonucleotide
ggaccuacuacugccuauc

SEQ ID NO: 110 - RNA, 19 nt, Artificial Sequence
  Description of Artificial Sequence: Synthetic oligonucleotide
gaccuacuacugccuauca

SEQ ID NO: 111 - RNA, 19 nt, Artificial Sequence
  Description of Artificial Sequence: Synthetic oligonucleotide
accuacuacugccuaucaa

SEQ ID NO: 112 - RNA, 19 nt, Artificial Sequence
  Description of Artificial Sequence: Synthetic oligonucleotide
cuacuacugccuaucaaaa

SEQ ID NO: 113 - RNA, 19 nt, Artificial Sequence
  Description of Artificial Sequence: Synthetic oligonucleotide
uacuacugccuaucaaaac

SEQ ID NO: 114 - RNA, 19 nt, Artificial Sequence
  Description of Artificial Sequence: Synthetic oligonucleotide
acuacugccuaucaaaacg

SEQ ID NO: 115 - RNA, 19 nt, Artificial Sequence
  Description of Artificial Sequence: Synthetic oligonucleotide
cuacugccuaucaaaacgc

SEQ ID NO: 116 - RNA, 19 nt, Artificial Sequence
  Description of Artificial Sequence: Synthetic oligonucleotide
uacugccuaucaaaacgcc

SEQ ID NO: 117 - RNA, 19 nt, Artificial Sequence
  Description of Artificial Sequence: Synthetic oligonucleotide
cugccuaucaaaacgccca

SEQ ID NO: 118 - RNA, 19 nt, Artificial Sequence
  Description of Artificial Sequence: Synthetic oligonucleotide
aucaaaacgcccaccacaa

SEQ ID NO: 119 - RNA, 19 nt, Artificial Sequence
  Description of Artificial Sequence: Synthetic oligonucleotide
ucaaaacgcccaccacaaa

SEQ ID NO: 120 - RNA, 19 nt, Artificial Sequence
  Description of Artificial Sequence: Synthetic oligonucleotide
caaaacgcccaccacaaau

SEQ ID NO: 121 - RNA, 19 nt, Artificial Sequence
  Description of Artificial Sequence: Synthetic oligonucleotide
aaaacgcccaccacaaaug

SEQ ID NO: 122 - RNA, 19 nt, Artificial Sequence
  Description of Artificial Sequence: Synthetic oligonucleotide
aacgcccaccacaaaugca

SEQ ID NO: 123 - RNA, 19 nt, Artificial Sequence
  Description of Artificial Sequence: Synthetic oligonucleotide
cgcccaccacaaaugcagu

SEQ ID NO: 124 - RNA, 19 nt, Artificial Sequence
  Description of Artificial Sequence: Synthetic oligonucleotide
gcccaccacaaaugcagug

SEQ ID NO: 125 - RNA, 19 nt, Artificial Sequence
  Description of Artificial Sequence: Synthetic oligonucleotide
cacaaaugcagugcacaag

SEQ ID NO: 126 - RNA, 19 nt, Artificial Sequence
  Description of Artificial Sequence: Synthetic oligonucleotide
acaaaugcagugcacaagu

SEQ ID NO: 127 - RNA, 19 nt, Artificial Sequence
  Description of Artificial Sequence: Synthetic oligonucleotide
caaaugcagugcacaagug

SEQ ID NO: 128 - RNA, 19 nt, Artificial Sequence
  Description of Artificial Sequence: Synthetic oligonucleotide
gcccaguggauaaccagcu

SEQ ID NO: 129 - RNA, 19 nt, Artificial Sequence
  Description of Artificial Sequence: Synthetic oligonucleotide
cccaguggauaaccagcuu

SEQ ID NO: 130 - RNA, 19 nt, Artificial Sequence
  Description of Artificial Sequence: Synthetic oligonucleotide
ccaguggauaaccagcuuc

SEQ ID NO: 131 - RNA, 19 nt, Artificial Sequence
  Description of Artificial Sequence: Synthetic oligonucleotide
caguggauaaccagcuucc

SEQ ID NO: 132 - RNA, 19 nt, Artificial Sequence
  Description of Artificial Sequence: Synthetic oligonucleotide
aguggauaaccagcuuccu

SEQ ID NO: 133 - RNA, 19 nt, Artificial Sequence
  Description of Artificial Sequence: Synthetic oligonucleotide
guggauaaccagcuuccug

SEQ ID NO: 134 - RNA, 19 nt, Artificial Sequence
  Description of Artificial Sequence: Synthetic oligonucleotide
uggauaaccagcuuccuga

SEQ ID NO: 135 - RNA, 19 nt, Artificial Sequence
  Description of Artificial Sequence: Synthetic oligonucleotide
ggauaaccagcuuccugaa

SEQ ID NO: 136 - RNA, 19 nt, Artificial Sequence
  Description of Artificial Sequence: Synthetic oligonucleotide
gauaaccagcuuccugaag

SEQ ID NO: 137 - RNA, 19 nt, Artificial Sequence
  Description of Artificial Sequence: Synthetic oligonucleotide
auaaccagcuuccugaagu

SEQ ID NO: 138 - RNA, 19 nt, Artificial Sequence
  Description of Artificial Sequence: Synthetic oligonucleotide
uaaccagcuuccugaaguc

SEQ ID NO: 139 - RNA, 19 nt, Artificial Sequence
  Description of Artificial Sequence: Synthetic oligonucleotide
aaccagcuuccugaaguca

SEQ ID NO: 140 - RNA, 19 nt, Artificial Sequence
  Description of Artificial Sequence: Synthetic oligonucleotide
accagcuuccugaagucac

SEQ ID NO: 141 - RNA, 19 nt, Artificial Sequence
  Description of Artificial Sequence: Synthetic oligonucleotide
ccagcuuccugaagucaca

SEQ ID NO: 142 - RNA, 19 nt, Artificial Sequence
  Description of Artificial Sequence: Synthetic oligonucleotide
cagcuuccugaagucacag

SEQ ID NO: 143 - RNA, 19 nt, Artificial Sequence
  Description of Artificial Sequence: Synthetic oligonucleotide
agcuuccugaagucacagc

SEQ ID NO: 144 - RNA, 19 nt, Artificial Sequence
  Description of Artificial Sequence: Synthetic oligonucleotide
gcuuccugaagucacagcc

SEQ ID NO: 145 - RNA, 19 nt, Artificial Sequence
  Description of Artificial Sequence: Synthetic oligonucleotide
accgccuggugcacuucga

SEQ ID NO: 146 - RNA, 19 nt, Artificial Sequence
  Description of Artificial Sequence: Synthetic oligonucleotide
cgccuggugcacuucgagc

SEQ ID NO: 147 - RNA, 19 nt, Artificial Sequence
  Description of Artificial Sequence: Synthetic oligonucleotide
gccuggugcacuucgagcc

SEQ ID NO: 148 - RNA, 19 nt, Artificial Sequence
  Description of Artificial Sequence: Synthetic oligonucleotide
ccuggugcacuucgagccu

SEQ ID NO: 149 - RNA, 19 nt, Artificial Sequence
  Description of Artificial Sequence: Synthetic oligonucleotide
gugcacuucgagccucaca

SEQ ID NO: 150 - RNA, 19 nt, Artificial Sequence
  Description of Artificial Sequence: Synthetic oligonucleotide
cacuucgagccucacaugc

SEQ ID NO: 151 - RNA, 19 nt, Artificial Sequence
  Description of Artificial Sequence: Synthetic oligonucleotide
cacaugcgaccgagacguc

SEQ ID NO: 152 - RNA, 19 nt, Artificial Sequence
  Description of Artificial Sequence: Synthetic oligonucleotide
caugcgaccgagacguccu

SEQ ID NO: 153 - RNA, 19 nt, Artificial Sequence
  Description of Artificial Sequence: Synthetic oligonucleotide
gcgaccgagacguccucau

SEQ ID NO: 154 - RNA, 19 nt, Artificial Sequence
  Description of Artificial Sequence: Synthetic oligonucleotide
cgaccgagacguccucauc

SEQ ID NO: 155 - RNA, 19 nt, Artificial Sequence
  Description of Artificial Sequence: Synthetic oligonucleotide
accgagacguccucaucaa

SEQ ID NO: 156 - RNA, 19 nt, Artificial Sequence
  Description of Artificial Sequence: Synthetic oligonucleotide
ccgagacguccucaucaaa

SEQ ID NO: 157 - RNA, 19 nt, Artificial Sequence
  Description of Artificial Sequence: Synthetic oligonucleotide
cgagacguccucaucaaau

SEQ ID NO: 158 - RNA, 19 nt, Artificial Sequence
  Description of Artificial Sequence: Synthetic oligonucleotide
gagacguccucaucaaaua

SEQ ID NO: 159 - RNA, 19 nt, Artificial Sequence
  Description of Artificial Sequence: Synthetic oligonucleotide
agacguccucaucaaauag

SEQ ID NO: 160 - RNA, 19 nt, Artificial Sequence
  Description of Artificial Sequence: Synthetic oligonucleotide
gacguccucaucaaauagc

SEQ ID NO: 161 - RNA, 19 nt, Artificial Sequence
  Description of Artificial Sequence: Synthetic oligonucleotide
acguccucaucaaauagca

SEQ ID NO: 162 - RNA, 19 nt, Artificial Sequence
  Description of Artificial Sequence: Synthetic oligonucleotide
cguccucaucaaauagcag

SEQ ID NO: 163 - RNA, 19 nt, Artificial Sequence
  Description of Artificial Sequence: Synthetic oligonucleotide
guccucaucaaauagcaga

SEQ ID NO: 164 - RNA, 19 nt, Artificial Sequence
  Description of Artificial Sequence: Synthetic oligonucleotide
uccucaucaaauagcagac

SEQ ID NO: 165 - RNA, 19 nt, Artificial Sequence
  Description of Artificial Sequence: Synthetic oligonucleotide
ccucaucaaauagcagacu

SEQ ID NO: 166 - RNA, 19 nt, Artificial Sequence
  Description of Artificial Sequence: Synthetic oligonucleotide
cucaucaaauagcagacuu

SEQ ID NO: 167 - RNA, 19 nt, Artificial Sequence
  Description of Artificial Sequence: Synthetic oligonucleotide
ucaucaaauagcagacuug

SEQ ID NO: 168 - RNA, 19 nt, Artificial Sequence
  Description of Artificial Sequence: Synthetic oligonucleotide
caucaaauagcagacuugu

SEQ ID NO: 169 - RNA, 19 nt, Artificial Sequence
  Description of Artificial Sequence: Synthetic oligonucleotide
aucaaauagcagacuuguu

SEQ ID NO: 170 - RNA, 19 nt, Artificial Sequence
  Description of Artificial Sequence: Synthetic oligonucleotide
ucaaauagcagacuuguuc

SEQ ID NO: 171 - RNA, 19 nt, Artificial Sequence
  Description of Artificial Sequence: Synthetic oligonucleotide
caaauagcagacuuguucc

SEQ ID NO: 172 - RNA, 19 nt, Artificial Sequence
  Description of Artificial Sequence: Synthetic oligonucleotide
aaauagcagacuuguuccg

SEQ ID NO: 173 - RNA, 19 nt, Artificial Sequence
  Description of Artificial Sequence: Synthetic oligonucleotide
aauagcagacuuguuccga

SEQ ID NO: 174 - RNA, 19 nt, Artificial Sequence
  Description of Artificial Sequence: Synthetic oligonucleotide
auagcagacuuguuccgac

SEQ ID NO: 175 - RNA, 19 nt, Artificial Sequence
  Description of Artificial Sequence: Synthetic oligonucleotide
uagcagacuuguuccgacc

SEQ ID NO: 176 - RNA, 19 nt, Artificial Sequence
  Description of Artificial Sequence: Synthetic oligonucleotide
agcagacuuguuccgaccc

SEQ ID NO: 177 - RNA, 19 nt, Artificial Sequence
  Description of Artificial Sequence: Synthetic oligonucleotide
gcagacuuguuccgaccca

SEQ ID NO: 178 - RNA, 19 nt, Artificial Sequence
  Description of Artificial Sequence: Synthetic oligonucleotide
cagacuuguuccgacccaa

SEQ ID NO: 179 - RNA, 19 nt, Artificial Sequence
  Description of Artificial Sequence: Synthetic oligonucleotide
agacuuguuccgacccaag

SEQ ID NO: 180 - RNA, 19 nt, Artificial Sequence
  Description of Artificial Sequence: Synthetic oligonucleotide
gacuuguuccgacccaagg

SEQ ID NO: 181 - RNA, 19 nt, Artificial Sequence
  Description of Artificial Sequence: Synthetic oligonucleotide
acuuguuccgacccaagga

SEQ ID NO: 182 - RNA, 19 nt, Artificial Sequence
  Description of Artificial Sequence: Synthetic oligonucleotide
cuuguuccgacccaaggac

SEQ ID NO: 183 - RNA, 19 nt, Artificial Sequence
  Description of Artificial Sequence: Synthetic oligonucleotide
uuguuccgacccaaggacc

SEQ ID NO: 184 - RNA, 19 nt, Artificial Sequence
  Description of Artificial Sequence: Synthetic oligonucleotide
uguuccgacccaaggacca

SEQ ID NO: 185 - RNA, 19 nt, Artificial Sequence
  Description of Artificial Sequence: Synthetic oligonucleotide
guuccgacccaaggaccag

SEQ ID NO: 186 - RNA, 19 nt, Artificial Sequence
  Description of Artificial Sequence: Synthetic oligonucleotide
uuccgacccaaggaccaga

SEQ ID NO: 187 - RNA, 19 nt, Artificial Sequence
  Description of Artificial Sequence: Synthetic oligonucleotide
uccgacccaaggaccagau

SEQ ID NO: 188 - RNA, 19 nt, Artificial Sequence
  Description of Artificial Sequence: Synthetic oligonucleotide
ccgacccaaggaccagauu

SEQ ID NO: 189 - RNA, 19 nt, Artificial Sequence
  Description of Artificial Sequence: Synthetic oligonucleotide
cgacccaaggaccagauug

SEQ ID NO: 190 - RNA, 19 nt, Artificial Sequence
  Description of Artificial Sequence: Synthetic oligonucleotide
gacccaaggaccagauugc

SEQ ID NO: 191 - RNA, 19 nt, Artificial Sequence
  Description of Artificial Sequence: Synthetic oligonucleotide
acccaaggaccagauugcu

SEQ ID NO: 192 - RNA, 19 nt, Artificial Sequence
  Description of Artificial Sequence: Synthetic oligonucleotide
cccaaggaccagauugcuu

SEQ ID NO: 193 - RNA, 19 nt, Artificial Sequence
  Description of Artificial Sequence: Synthetic oligonucleotide
ccaaggaccagauugcuua

SEQ ID NO: 194 - RNA, 19 nt, Artificial Sequence
  Description of Artificial Sequence: Synthetic oligonucleotide
caaggaccagauugcuuac

SEQ ID NO: 195 - RNA, 19 nt, Artificial Sequence
  Description of Artificial Sequence: Synthetic oligonucleotide
aaggaccagauugcuuacu

SEQ ID NO: 196 - RNA, 19 nt, Artificial Sequence
  Description of Artificial Sequence: Synthetic oligonucleotide
aggaccagauugcuuacuc

SEQ ID NO: 197 - RNA, 19 nt, Artificial Sequence
  Description of Artificial Sequence: Synthetic oligonucleotide
ggaccagauugcuuacuca

SEQ ID NO: 198 - RNA, 19 nt, Artificial Sequence
  Description of Artificial Sequence: Synthetic oligonucleotide
gaccagauugcuuacucag

SEQ ID NO: 199 - RNA, 19 nt, Artificial Sequence
  Description of Artificial Sequence: Synthetic oligonucleotide
accagauugcuuacucaga

SEQ ID NO: 200 - RNA, 19 nt, Artificial Sequence
  Description of Artificial Sequence: Synthetic oligonucleotide
ccagauugcuuacucagac

SEQ ID NO: 201 - RNA, 19 nt, Artificial Sequence
  Description of Artificial Sequence: Synthetic oligonucleotide
cagauugcuuacucagaca

SEQ ID NO: 202 - RNA, 19 nt, Artificial Sequence
  Description of Artificial Sequence: Synthetic oligonucleotide
agauugcuuacucagacac

SEQ ID NO: 203 - RNA, 19 nt, Artificial Sequence
  Description of Artificial Sequence: Synthetic oligonucleotide
gauugcuuacucagacacc

SEQ ID NO: 204 - RNA, 19 nt, Artificial Sequence
  Description of Artificial Sequence: Synthetic oligonucleotide
auugcuuacucagacacca

SEQ ID NO: 205 - RNA, 19 nt, Artificial Sequence
  Description of Artificial Sequence: Synthetic oligonucleotide
uugcuuacucagacaccag

SEQ ID NO: 206 - RNA, 19 nt, Artificial Sequence
  Description of Artificial Sequence: Synthetic oligonucleotide
ugcuuacucagacaccagc

SEQ ID NO: 207 - RNA, 19 nt, Artificial Sequence
  Description of Artificial Sequence: Synthetic oligonucleotide
gcuuacucagacaccagcc

SEQ ID NO: 208 - RNA, 19 nt, Artificial Sequence
  Description of Artificial Sequence: Synthetic oligonucleotide
cuuacucagacaccagccc

SEQ ID NO: 209 - RNA, 19 nt, Artificial Sequence
  Description of Artificial Sequence: Synthetic oligonucleotide
uuacucagacaccagccca

SEQ ID NO: 210 - RNA, 19 nt, Artificial Sequence
  Description of Artificial Sequence: Synthetic oligonucleotide
uacucagacaccagcccau

SEQ ID NO: 211 - RNA, 19 nt, Artificial Sequence
  Description of Artificial Sequence: Synthetic oligonucleotide
acucagacaccagcccauu

SEQ ID NO: 212 - RNA, 19 nt, Artificial Sequence
  Description of Artificial Sequence: Synthetic oligonucleotide
cucagacaccagcccauuc

SEQ ID NO: 213 - RNA, 19 nt, Artificial Sequence
  Description of Artificial Sequence: Synthetic oligonucleotide
ucagacaccagcccauucu

SEQ ID NO: 214 - RNA, 19 nt, Artificial Sequence
  Description of Artificial Sequence: Synthetic oligonucleotide
cagacaccagcccauucuu

SEQ ID NO: 215 - RNA, 19 nt, Artificial Sequence
  Description of Artificial Sequence: Synthetic oligonucleotide
agacaccagcccauucuug

SEQ ID NO: 216 - RNA, 19 nt, Artificial Sequence
  Description of Artificial Sequence: Synthetic oligonucleotide
gacaccagcccauucuuga

SEQ ID NO: 217 - RNA, 19 nt, Artificial Sequence
  Description of Artificial Sequence: Synthetic oligonucleotide
acaccagcccauucuugau

SEQ ID NO: 218 - RNA, 19 nt, Artificial Sequence
  Description of Artificial Sequence: Synthetic oligonucleotide
caccagcccauucuugauc

SEQ ID NO: 219 - RNA, 19 nt, Artificial Sequence
  Description of Artificial Sequence: Synthetic oligonucleotide
accagcccauucuugaucc

SEQ ID NO: 220 - RNA, 19 nt, Artificial Sequence
  Description of Artificial Sequence: Synthetic oligonucleotide
ccagcccauucuugauccu

SEQ ID NO: 221 - RNA, 19 nt, Artificial Sequence
  Description of Artificial Sequence: Synthetic oligonucleotide
cagcccauucuugauccuu

SEQ ID NO: 222 - RNA, 19 nt, Artificial Sequence
  Description of Artificial Sequence: Synthetic oligonucleotide
agcccauucuugauccuuu

SEQ ID NO: 223 - RNA, 19 nt, Artificial Sequence
  Description of Artificial Sequence: Synthetic oligonucleotide
cauucuugauccuuucuga

SEQ ID NO: 224 - RNA, 19 nt, Artificial Sequence
  Description of Artificial Sequence: Synthetic oligonucleotide
auucuugauccuuucugag

SEQ ID NO: 225 - RNA, 19 nt, Artificial Sequence
  Description of Artificial Sequence: Synthetic oligonucleotide
aucucaacuccaggcuaga

SEQ ID NO: 226 - RNA, 19 nt, Artificial Sequence
  Description of Artificial Sequence: Synthetic oligonucleotide
cucaacuccaggcuagaga

SEQ ID NO: 227 - RNA, 19 nt, Artificial Sequence
  Description of Artificial Sequence: Synthetic oligonucleotide
caacuccaggcuagagaag

SEQ ID NO: 228 - RNA, 19 nt, Artificial Sequence
  Description of Artificial Sequence: Synthetic oligonucleotide
aacuccaggcuagagaaga

SEQ ID NO: 229 - RNA, 19 nt, Artificial Sequence
  Description of Artificial Sequence: Synthetic oligonucleotide
acuccaggcuagagaagaa

SEQ ID NO: 230 - RNA, 19 nt, Artificial Sequence
  Description of Artificial Sequence: Synthetic oligonucleotide
cuccaggcuagagaagaaa

SEQ ID NO: 231 - RNA, 19 nt, Artificial Sequence
  Description of Artificial Sequence: Synthetic oligonucleotide
ccaggcuagagaagaaagu

SEQ ID NO: 232 - RNA, 19 nt, Artificial Sequence
  Description of Artificial Sequence: Synthetic oligonucleotide
caggcuagagaagaaaguu

SEQ ID NO: 233 - RNA, 19 nt, Artificial Sequence
  Description of Artificial Sequence: Synthetic oligonucleotide
aggcuagagaagaaaguua

SEQ ID NO: 234 - RNA, 19 nt, Artificial Sequence
  Description of Artificial Sequence: Synthetic oligonucleotide
ggcuagagaagaaaguuaa

SEQ ID NO: 235 - RNA, 19 nt, Artificial Sequence
  Description of Artificial Sequence: Synthetic oligonucleotide
gcuagagaagaaaguuaaa

SEQ ID NO: 236 - RNA, 19 nt, Artificial Sequence
  Description of Artificial Sequence: Synthetic oligonucleotide
cuagagaagaaaguuaaag

SEQ ID NO: 237 - RNA, 19 nt, Artificial Sequence
  Description of Artificial Sequence: Synthetic oligonucleotide
uagagaagaaaguuaaagc

SEQ ID NO: 238 - RNA, 19 nt, Artificial Sequence
  Description of Artificial Sequence: Synthetic oligonucleotide
agagaagaaaguuaaagca

SEQ ID NO: 239 - RNA, 19 nt, Artificial Sequence
  Description of Artificial Sequence: Synthetic oligonucleotide
gagaagaaaguuaaagcaa

SEQ ID NO: 240 - RNA, 19 nt, Artificial Sequence
  Description of Artificial Sequence: Synthetic oligonucleotide
agaagaaaguuaaagcaac

SEQ ID NO: 241 - RNA, 19 nt, Artificial Sequence
  Description of Artificial Sequence: Synthetic oligonucleotide
gaagaaaguuaaagcaacc

SEQ ID NO: 242 - RNA, 19 nt, Artificial Sequence
  Description of Artificial Sequence: Synthetic oligonucleotide
aagaaaguuaaagcaacca

SEQ ID NO: 243 - RNA, 19 nt, Artificial Sequence
  Description of Artificial Sequence: Synthetic oligonucleotide
agaaaguuaaagcaaccaa

SEQ ID NO: 244 - RNA, 19 nt, Artificial Sequence
  Description of Artificial Sequence: Synthetic oligonucleotide
gaaaguuaaagcaaccaac

SEQ ID NO: 245 - RNA, 19 nt, Artificial Sequence
  Description of Artificial Sequence: Synthetic oligonucleotide
aaaguuaaagcaaccaacu

SEQ ID NO: 246 - RNA, 19 nt, Artificial Sequence
  Description of Artificial Sequence: Synthetic oligonucleotide
aaguuaaagcaaccaacuu

SEQ ID NO: 247 - RNA, 19 nt, Artificial Sequence
  Description of Artificial Sequence: Synthetic oligonucleotide
guuaaagcaaccaacuuca

SEQ ID NO: 248 - RNA, 19 nt, Artificial Sequence
  Description of Artificial Sequence: Synthetic oligonucleotide
uuaaagcaaccaacuucag

SEQ ID NO: 249 - RNA, 19 nt, Artificial Sequence
  Description of Artificial Sequence: Synthetic oligonucleotide
uaaagcaaccaacuucagg

SEQ ID NO: 250 - RNA, 19 nt, Artificial Sequence
  Description of Artificial Sequence: Synthetic oligonucleotide
aaagcaaccaacuucaggc

SEQ ID NO: 251 - RNA, 19 nt, Artificial Sequence
  Description of Artificial Sequence: Synthetic oligonucleotide
aagcaaccaacuucaggcc

SEQ ID NO: 252 - RNA, 19 nt, Artificial Sequence
  Description of Artificial Sequence: Synthetic oligonucleotide
agcaaccaacuucaggccc

SEQ ID NO: 253 - RNA, 19 nt, Artificial Sequence
  Description of Artificial Sequence: Synthetic oligonucleotide
gcaaccaacuucaggccca

SEQ ID NO: 254 - RNA, 19 nt, Artificial Sequence
  Description of Artificial Sequence: Synthetic oligonucleotide
aaccaacuucaggcccaau

SEQ ID NO: 255 - RNA, 19 nt, Artificial Sequence
  Description of Artificial Sequence: Synthetic oligonucleotide
accaacuucaggcccaaua

SEQ ID NO: 256 - RNA, 19 nt, Artificial Sequence
  Description of Artificial Sequence: Synthetic oligonucleotide
ccaacuucaggcccaauau

SEQ ID NO: 257 - RNA, 19 nt, Artificial Sequence
  Description of Artificial Sequence: Synthetic oligonucleotide
caacuucaggcccaauauu

SEQ ID NO: 258 - RNA, 19 nt, Artificial Sequence
  Description of Artificial Sequence: Synthetic oligonucleotide
aacuucaggcccaauauug

SEQ ID NO: 259 - RNA, 19 nt, Artificial Sequence
  Description of Artificial Sequence: Synthetic oligonucleotide
acuucaggcccaauauugu

SEQ ID NO: 260 - RNA, 19 nt, Artificial Sequence
  Description of Artificial Sequence: Synthetic oligonucleotide
cuucaggcccaauauugua

SEQ ID NO: 261 - RNA, 19 nt, Artificial Sequence
  Description of Artificial Sequence: Synthetic oligonucleotide
uucaggcccaauauuguaa

SEQ ID NO: 262 - RNA, 19 nt, Artificial Sequence
  Description of Artificial Sequence: Synthetic oligonucleotide
ucaggcccaauauuguaau

SEQ ID NO: 263 - RNA, 19 nt, Artificial Sequence
  Description of Artificial Sequence: Synthetic oligonucleotide
caggcccaauauuguaauu

SEQ ID NO: 264 - RNA, 19 nt, Artificial Sequence
  Description of Artificial Sequence: Synthetic oligonucleotide
aggcccaauauuguaauuu

SEQ ID NO: 265 - RNA, 19 nt, Artificial Sequence
  Description of Artificial Sequence: Synthetic oligonucleotide
ggcccaauauuguaauuuc

SEQ ID NO: 266 - RNA, 19 nt, Artificial Sequence
  Description of Artificial Sequence: Synthetic oligonucleotide
gcccaauauuguaauuuca

SEQ ID NO: 267 - RNA, 19 nt, Artificial Sequence
  Description of Artificial Sequence: Synthetic oligonucleotide
cccaauauuguaauuucag

SEQ ID NO: 268 - RNA, 19 nt, Artificial Sequence
  Description of Artificial Sequence: Synthetic oligonucleotide
ccaauauuguaauuucagg

SEQ ID NO: 269 - RNA, 19 nt, Artificial Sequence
  Description of Artificial Sequence: Synthetic oligonucleotide
caauauuguaauuucagga

SEQ ID NO: 270 - RNA, 19 nt, Artificial Sequence
  Description of Artificial Sequence: Synthetic oligonucleotide
aauauuguaauuucaggau

SEQ ID NO: 271 - RNA, 19 nt, Artificial Sequence
  Description of Artificial Sequence: Synthetic oligonucleotide
auauuguaauuucaggaug

SEQ ID NO: 272 - RNA, 19 nt, Artificial Sequence
  Description of Artificial Sequence: Synthetic oligonucleotide
uauuguaauuucaggaugc

SEQ ID NO: 273 - RNA, 19 nt, Artificial Sequence
  Description of Artificial Sequence: Synthetic oligonucleotide
auuguaauuucaggaugcg

SEQ ID NO: 274 - RNA, 19 nt, Artificial Sequence
  Description of Artificial Sequence: Synthetic oligonucleotide
uuguaauuucaggaugcga

SEQ ID NO: 275 - RNA, 19 nt, Artificial Sequence
  Description of Artificial Sequence: Synthetic oligonucleotide
uguaauuucaggaugcgau

SEQ ID NO: 276 - RNA, 19 nt, Artificial Sequence
  Description of Artificial Sequence: Synthetic oligonucleotide
guaauuucaggaugcgaug

SEQ ID NO: 277 - RNA, 19 nt, Artificial Sequence
  Description of Artificial Sequence: Synthetic oligonucleotide
uaauuucaggaugcgaugu

SEQ ID NO: 278 - RNA, 19 nt, Artificial Sequence
  Description of Artificial Sequence: Synthetic oligonucleotide
aauuucaggaugcgauguc

SEQ ID NO: 279 - RNA, 19 nt, Artificial Sequence
  Description of Artificial Sequence: Synthetic oligonucleotide
auuucaggaugcgaugucu

SEQ ID NO: 280 - RNA, 19 nt, Artificial Sequence
  Description of Artificial Sequence: Synthetic oligonucleotide
uuucaggaugcgaugucua

SEQ ID NO: 281 - RNA, 19 nt, Artificial Sequence
  Description of Artificial Sequence: Synthetic oligonucleotide
uucaggaugcgaugucuau

SEQ ID NO: 282 - RNA, 19 nt, Artificial Sequence
  Description of Artificial Sequence: Synthetic oligonucleotide
ucaggaugcgaugucuaug

SEQ ID NO: 283 - RNA, 19 nt, Artificial Sequence
  Description of Artificial Sequence: Synthetic oligonucleotide
caggaugcgaugucuaugc

SEQ ID NO: 284 - RNA, 19 nt, Artificial Sequence
  Description of Artificial Sequence: Synthetic oligonucleotide
aggaugcgaugucuaugca

SEQ ID NO: 285 - RNA, 19 nt, Artificial Sequence
  Description of Artificial Sequence: Synthetic oligonucleotide
ggaugcgaugucuaugcag

SEQ ID NO: 286 - RNA, 19 nt, Artificial Sequence
  Description of Artificial Sequence: Synthetic oligonucleotide
gaugcgaugucuaugcaga

SEQ ID NO: 287 - RNA, 19 nt, Artificial Sequence
  Description of Artificial Sequence: Synthetic oligonucleotide
augcgaugucuaugcagag

SEQ ID NO: 288 - RNA, 19 nt, Artificial Sequence
  Description of Artificial Sequence: Synthetic oligonucleotide
ugcgaugucuaugcagagg

SEQ ID NO: 289 - RNA, 19 nt, Artificial Sequence
  Description of Artificial Sequence: Synthetic oligonucleotide
uuguuccagaugcauuuua

SEQ ID NO: 290 - RNA, 19 nt, Artificial Sequence
  Description of Artificial Sequence: Synthetic oligonucleotide
ggaaacacugaagaguuau

SEQ ID NO: 291 - RNA, 19 nt, Artificial Sequence
  Description of Artificial Sequence: Synthetic oligonucleotide
gaaacacugaagaguuauc

SEQ ID NO: 292 - RNA, 19 nt, Artificial Sequence
  Description of Artificial Sequence: Synthetic oligonucleotide
cacugaagaguuaucgcca

SEQ ID NO: 293 - RNA, 19 nt, Artificial Sequence
  Description of Artificial Sequence: Synthetic oligonucleotide
gugacccuucagaacgaaa

SEQ ID NO: 294 - RNA, 19 nt, Artificial Sequence
  Description of Artificial Sequence: Synthetic oligonucleotide
cccuucagaacgaaaguua

SEQ ID NO: 295 - RNA, 19 nt, Artificial Sequence
  Description of Artificial Sequence: Synthetic oligonucleotide
ccuucagaacgaaaguuau

SEQ ID NO: 296 - RNA, 19 nt, Artificial Sequence
  Description of Artificial Sequence: Synthetic oligonucleotide
ucagaacgaaaguuauaug

SEQ ID NO: 297 - RNA, 19 nt, Artificial Sequence
  Description of Artificial Sequence: Synthetic oligonucleotide
cagaacgaaaguuauaugg

SEQ ID NO: 298 - RNA, 19 nt, Artificial Sequence
  Description of Artificial Sequence: Synthetic oligonucleotide
agaacgaaaguuauaugga

SEQ ID NO: 299 - RNA, 19 nt, Artificial Sequence
  Description of Artificial Sequence: Synthetic oligonucleotide
gaacgaaaguuauauggaa

SEQ ID NO: 300 - RNA, 19 nt, Artificial Sequence
  Description of Artificial Sequence: Synthetic oligonucleotide
aacgaaaguuauauggaaa

SEQ ID NO: 301 - RNA, 19 nt, Artificial Sequence
  Description of Artificial Sequence: Synthetic oligonucleotide
cgaaaguuauauggaaaau

SEQ ID NO: 302 - RNA, 19 nt, Artificial Sequence
  Description of Artificial Sequence: Synthetic oligonucleotide
gaaaguuauauggaaaauc

SEQ ID NO: 303 - RNA, 19 nt, Artificial Sequence
  Description of Artificial Sequence: Synthetic oligonucleotide
aaaguuauauggaaaauca

SEQ ID NO: 304 - RNA, 19 nt, Artificial Sequence
  Description of Artificial Sequence: Synthetic oligonucleotide
aaaaauguucucaaaaaug

SEQ ID NO: 305 - RNA, 19 nt, Artificial Sequence
  Description of Artificial Sequence: Synthetic oligonucleotide
guucucaaaaaugacaaca

SEQ ID NO: 306 - RNA, 19 nt, Artificial Sequence
  Description of Artificial Sequence: Synthetic oligonucleotide
caaaaaugacaacacuuga

SEQ ID NO: 307 - RNA, 19 nt, Artificial Sequence
  Description of Artificial Sequence: Synthetic oligonucleotide
augacaacacuugaagcau

SEQ ID NO: 308 - RNA, 19 nt, Artificial Sequence
  Description of Artificial Sequence: Synthetic oligonucleotide
acaacacuugaagcauggu

SEQ ID NO: 309 - RNA, 19 nt, Artificial Sequence
  Description of Artificial Sequence: Synthetic oligonucleotide
caacacuugaagcauggug

SEQ ID NO: 310 - RNA, 19 nt, Artificial Sequence
  Description of Artificial Sequence: Synthetic oligonucleotide
aacacuugaagcauggugu

SEQ ID NO: 311 - RNA, 19 nt, Artificial Sequence
  Description of Artificial Sequence: Synthetic oligonucleotide
acacuugaagcaugguguu

SEQ ID NO: 312 - RNA, 19 nt, Artificial Sequence
  Description of Artificial Sequence: Synthetic oligonucleotide
cacuugaagcaugguguuu

SEQ ID NO: 313 - RNA, 19 nt, Artificial Sequence
  Description of Artificial Sequence: Synthetic oligonucleotide
cuugaagcaugguguuuca

SEQ ID NO: 314 - RNA, 19 nt, Artificial Sequence
  Description of Artificial Sequence: Synthetic oligonucleotide
uugaagcaugguguuucag

SEQ ID NO: 315 - RNA, 19 nt, Artificial Sequence
  Description of Artificial Sequence: Synthetic oligonucleotide
ugaagcaugguguuucaga

SEQ ID NO: 316 - RNA, 19 nt, Artificial Sequence
  Description of Artificial Sequence: Synthetic oligonucleotide
gaagcaugguguuucagaa

SEQ ID NO: 317 - RNA, 19 nt, Artificial Sequence
  Description of Artificial Sequence: Synthetic oligonucleotide
caugguguuucagaacuga

SEQ ID NO: 318 - RNA, 19 nt, Artificial Sequence
  Description of Artificial Sequence: Synthetic oligonucleotide
uguuucagaacugagaccu

SEQ ID NO: 319 - RNA, 19 nt, Artificial Sequence
  Description of Artificial Sequence: Synthetic oligonucleotide
acauuuucuuuaaauuugu

SEQ ID NO: 320 - RNA, 19 nt, Artificial Sequence
  Description of Artificial Sequence: Synthetic oligonucleotide
auuuucuuuaaauuuguga

SEQ ID NO: 321 - RNA, 19 nt, Artificial Sequence
  Description of Artificial Sequence: Synthetic oligonucleotide
uuuaaauuugugauuuuca

SEQ ID NO: 322 - RNA, 19 nt, Artificial Sequence
  Description of Artificial Sequence: Synthetic oligonucleotide
aauuugugauuuucacauu

SEQ ID NO: 323 - RNA, 19 nt, Artificial Sequence
  Description of Artificial Sequence: Synthetic oligonucleotide
uuugugauuuucacauuuu

SEQ ID NO: 324 - RNA, 19 nt, Artificial Sequence
  Description of Artificial Sequence: Synthetic oligonucleotide
guuuaacugauuauggaau

SEQ ID NO: 325 - RNA, 19 nt, Artificial Sequence
  Description of Artificial Sequence: Synthetic oligonucleotide
uuuaacugauuauggaaua

SEQ ID NO: 326 - RNA, 19 nt, Artificial Sequence
  Description of Artificial Sequence: Synthetic oligonucleotide
uaacugauuauggaauagu

SEQ ID NO: 327 - RNA, 19 nt, Artificial Sequence
  Description of Artificial Sequence: Synthetic oligonucleotide
aacugauuauggaauaguu

SEQ ID NO: 328 - RNA, 19 nt, Artificial Sequence
  Description of Artificial Sequence: Synthetic oligonucleotide
acugauuauggaauaguuc

SEQ ID NO: 329 - RNA, 19 nt, Artificial Sequence
  Description of Artificial Sequence: Synthetic oligonucleotide
cugauuauggaauaguucu

SEQ ID NO: 330 - RNA, 19 nt, Artificial Sequence
  Description of Artificial Sequence: Synthetic oligonucleotide
cagauauuaauuuuccaua

SEQ ID NO: 331 - RNA, 19 nt, Artificial Sequence
  Description of Artificial Sequence: Synthetic oligonucleotide
gauauuaauuuuccauaga

SEQ ID NO: 332 - RNA, 19 nt, Artificial Sequence
  Description of Artificial Sequence: Synthetic oligonucleotide
cuucucagacagcauugga

SEQ ID NO: 333 - RNA, 19 nt, Artificial Sequence
  Description of Artificial Sequence: Synthetic oligonucleotide
cucagacagcauuggauuu

SEQ ID NO: 334 - RNA, 19 nt, Artificial Sequence
  Description of Artificial Sequence: Synthetic oligonucleotide
ucagacagcauuggauuuc

SEQ ID NO: 335 - RNA, 19 nt, Artificial Sequence
  Description of Artificial Sequence: Synthetic oligonucleotide
agaaaagugauucagugau

SEQ ID NO: 336 - RNA, 19 nt, Artificial Sequence
  Description of Artificial Sequence: Synthetic oligonucleotide
aagugauucagugauuuca

SEQ ID NO: 337 - RNA, 19 nt, Artificial Sequence
  Description of Artificial Sequence: Synthetic oligonucleotide
ggaaagcauaugucaguug

SEQ ID NO: 338 - RNA, 19 nt, Artificial Sequence
  Description of Artificial Sequence: Synthetic oligonucleotide
gaaagcauaugucaguugu

SEQ ID NO: 339 - RNA, 19 nt, Artificial Sequence
  Description of Artificial Sequence: Synthetic oligonucleotide
uaugucaguuguuuaaaac

SEQ ID NO: 340 - RNA, 19 nt, Artificial Sequence
  Description of Artificial Sequence: Synthetic oligonucleotide
augucaguuguuuaaaacc

SEQ ID NO: 341 - RNA, 19 nt, Artificial Sequence
  Description of Artificial Sequence: Synthetic oligonucleotide
ugucaguuguuuaaaaccc

SEQ ID NO: 342 - RNA, 19 nt, Artificial Sequence
  Description of Artificial Sequence: Synthetic oligonucleotide
gucaguuguuuaaaaccca

SEQ ID NO: 343 - RNA, 19 nt, Artificial Sequence
  Description of Artificial Sequence: Synthetic oligonucleotide
aguuguuuaaaacccaaua

SEQ ID NO: 344 - RNA, 19 nt, Artificial Sequence
  Description of Artificial Sequence: Synthetic oligonucleotide
guuguuuaaaacccaauau

SEQ ID NO: 345 - RNA, 19 nt, Artificial Sequence
  Description of Artificial Sequence: Synthetic oligonucleotide
uuguuuaaaacccaauauc

SEQ ID NO: 346 - RNA, 19 nt, Artificial Sequence
  Description of Artificial Sequence: Synthetic oligonucleotide
uguuuaaaacccaauaucu

SEQ ID NO: 347 - RNA, 19 nt, Artificial Sequence
  Description of Artificial Sequence: Synthetic oligonucleotide
guuuaaaacccaauaucua

SEQ ID NO: 348 - RNA, 19 nt, Artificial Sequence
  Description of Artificial Sequence: Synthetic oligonucleotide
ugaugaaguauauuuuuua

SEQ ID NO: 349 - RNA, 19 nt, Artificial Sequence
  Description of Artificial Sequence: Synthetic oligonucleotide
gaugaaguauauuuuuuau

SEQ ID NO: 350 - RNA, 19 nt, Artificial Sequence
  Description of Artificial Sequence: Synthetic oligonucleotide
augaaguauauuuuuuauu

SEQ ID NO: 351 - RNA, 19 nt, Artificial Sequence
  Description of Artificial Sequence: Synthetic oligonucleotide
gaaguauauuuuuuauugc

SEQ ID NO: 352 - RNA, 19 nt, Artificial Sequence
  Description of Artificial Sequence: Synthetic oligonucleotide
aguauauuuuuuauugcca

SEQ ID NO: 353 - RNA, 19 nt, Artificial Sequence
  Description of Artificial Sequence: Synthetic oligonucleotide
auugccauuuuguccuuug

SEQ ID NO: 354 - RNA, 19 nt, Artificial Sequence
  Description of Artificial Sequence: Synthetic oligonucleotide
ugccauuuuguccuuugau

SEQ ID NO: 355 - RNA, 19 nt, Artificial Sequence
  Description of Artificial Sequence: Synthetic oligonucleotide
ggaaguugacuaaacuuga

SEQ ID NO: 356 - RNA, 19 nt, Artificial Sequence
  Description of Artificial Sequence: Synthetic oligonucleotide
aaguugacuaaacuugaaa

SEQ ID NO: 357 - RNA, 19 nt, Artificial Sequence
  Description of Artificial Sequence: Synthetic oligonucleotide
guugacuaaacuugaaaaa

SEQ ID NO: 358 - RNA, 19 nt, Artificial Sequence
  Description of Artificial Sequence: Synthetic oligonucleotide
uugacuaaacuugaaaaau

SEQ ID NO: 359 - RNA, 19 nt, Artificial Sequence
  Description of Artificial Sequence: Synthetic oligonucleotide
gacuaaacuugaaaaaugu

SEQ ID NO: 360 - RNA, 19 nt, Artificial Sequence
  Description of Artificial Sequence: Synthetic oligonucleotide
acuaaacuugaaaaauguu

SEQ ID NO: 361 - RNA, 19 nt, Artificial Sequence
  Description of Artificial Sequence: Synthetic oligonucleotide
cuaaacuugaaaaauguuu

SEQ ID NO: 362 - RNA, 19 nt, Artificial Sequence
  Description of Artificial Sequence: Synthetic oligonucleotide
cuugaaaaauguuuuuaaa

SEQ ID NO: 363 - RNA, 19 nt, Artificial Sequence
  Description of Artificial Sequence: Synthetic oligonucleotide
uugaaaaauguuuuuaaaa

SEQ ID NO: 364 - RNA, 19 nt, Artificial Sequence
  Description of Artificial Sequence: Synthetic oligonucleotide
gaaaaauguuuuuaaaacu

SEQ ID NO: 365 - RNA, 19 nt, Artificial Sequence
  Description of Artificial Sequence: Synthetic oligonucleotide
aaaaauguuuuuaaaacug

SEQ ID NO: 366 - RNA, 19 nt, Artificial Sequence
  Description of Artificial Sequence: Synthetic oligonucleotide
aaaauguuuuuaaaacugu

SEQ ID NO: 367 - RNA, 19 nt, Artificial Sequence
  Description of Artificial Sequence: Synthetic oligonucleotide
aaauguuuuuaaaacugug

SEQ ID NO: 368 - RNA, 19 nt, Artificial Sequence
  Description of Artificial Sequence: Synthetic oligonucleotide
aauguuuuuaaaacuguga

SEQ ID NO: 369 - RNA, 19 nt, Artificial Sequence
  Description of Artificial Sequence: Synthetic oligonucleotide
guuuuuaaaacugugaaua

SEQ ID NO: 370 - RNA, 19 nt, Artificial Sequence
  Description of Artificial Sequence: Synthetic oligonucleotide
uuuuuaaaacugugaauaa

SEQ ID NO: 371 - RNA, 19 nt, Artificial Sequence
  Description of Artificial Sequence: Synthetic oligonucleotide
uaaaacugugaauaaaugg

SEQ ID NO: 372 - RNA, 19 nt, Artificial Sequence
  Description of Artificial Sequence: Synthetic oligonucleotide
aaaacugugaauaaaugga

SEQ ID NO: 373 - RNA, 19 nt, Artificial Sequence
  Description of Artificial Sequence: Synthetic oligonucleotide
aaacugugaauaaauggaa

SEQ ID NO: 374 - RNA, 19 nt, Artificial Sequence
  Description of Artificial Sequence: Synthetic oligonucleotide
aacugugaauaaauggaag

SEQ ID NO: 375 - RNA, 19 nt, Artificial Sequence
  Description of Artificial Sequence: Synthetic oligonucleotide
cugugaauaaauggaagcu

SEQ ID NO: 376 - RNA, 19 nt, Artificial Sequence
  Description of Artificial Sequence: Synthetic oligonucleotide
ugugaauaaauggaagcua

SEQ ID NO: 377 - RNA, 19 nt, Artificial Sequence
  Description of Artificial Sequence: Synthetic oligonucleotide
gugaauaaauggaagcuac

SEQ ID NO: 378 - RNA, 19 nt, Artificial Sequence
  Description of Artificial Sequence: Synthetic oligonucleotide
ugaauaaauggaagcuacu

SEQ ID NO: 379 - RNA, 19 nt, Artificial Sequence
  Description of Artificial Sequence: Synthetic oligonucleotide
gaauaaauggaagcuacuu

SEQ ID NO: 380 - RNA, 19 nt, Artificial Sequence
  Description of Artificial Sequence: Synthetic oligonucleotide
aauaaauggaagcuacuuu

SEQ ID NO: 381 - RNA, 19 nt, Artificial Sequence
  Description of Artificial Sequence: Synthetic oligonucleotide
uaaauggaagcuacuuuga

SEQ ID NO: 382 - RNA, 19 nt, Artificial Sequence
  Description of Artificial Sequence: Synthetic oligonucleotide
aaauggaagcuacuuugac

SEQ ID NO: 383 - RNA, 19 nt, Artificial Sequence
  Description of Artificial Sequence: Synthetic oligonucleotide
auggaagcuacuuugacua

SEQ ID NO: 384 - RNA, 19 nt, Artificial Sequence
  Description of Artificial Sequence: Synthetic oligonucleotide
ggaagcuacuuugacuagu

SEQ ID NO: 385 - RNA, 19 nt, Artificial Sequence
  Description of Artificial Sequence: Synthetic oligonucleotide
gguagauccagagcugcgc

SEQ ID NO: 386 - RNA, 19 nt, Artificial Sequence
  Description of Artificial Sequence: Synthetic oligonucleotide
aggguagauccagagcugc

SEQ ID NO: 387 - RNA, 19 nt, Artificial Sequence
  Description of Artificial Sequence: Synthetic oligonucleotide
caggguagauccagagcug

SEQ ID NO: 388 - RNA, 19 nt, Artificial Sequence
  Description of Artificial Sequence: Synthetic oligonucleotide
acaggguagauccagagcu

SEQ ID NO: 389 - RNA, 19 nt, Artificial Sequence
  Description of Artificial Sequence: Synthetic oligonucleotide
cacaggguagauccagagc

SEQ ID NO: 390 - RNA, 19 nt, Artificial Sequence
  Description of Artificial Sequence: Synthetic oligonucleotide
ucacaggguagauccagag

SEQ ID NO: 391 - RNA, 19 nt, Artificial Sequence
  Description of Artificial Sequence: Synthetic oligonucleotide
uucacaggguagauccaga

SEQ ID NO: 392 - RNA, 19 nt, Artificial Sequence
  Description of Artificial Sequence: Synthetic oligonucleotide
uuucacaggguagauccag

SEQ ID NO: 393 - RNA, 19 nt, Artificial Sequence
  Description of Artificial Sequence: Synthetic oligonucleotide
auuucacaggguagaucca

SEQ ID NO: 394 - RNA, 19 nt, Artificial Sequence
  Description of Artificial Sequence: Synthetic oligonucleotide
gauuucacaggguagaucc

SEQ ID NO: 395 - RNA, 19 nt, Artificial Sequence
  Description of Artificial Sequence: Synthetic oligonucleotide
ggauuucacaggguagauc

SEQ ID NO: 396 - RNA, 19 nt, Artificial Sequence
  Description of Artificial Sequence: Synthetic oligonucleotide
aggauuucacaggguagau

SEQ ID NO: 397 - RNA, 19 nt, Artificial Sequence
  Description of Artificial Sequence: Synthetic oligonucleotide
caggauuucacaggguaga

SEQ ID NO: 398 - RNA, 19 nt, Artificial Sequence
  Description of Artificial Sequence: Synthetic oligonucleotide
gcaggauuucacaggguag

SEQ ID NO: 399 - RNA, 19 nt, Artificial Sequence
  Description of Artificial Sequence: Synthetic oligonucleotide
uugcaggauuucacagggu

SEQ ID NO: 400 - RNA, 19 nt, Artificial Sequence
  Description of Artificial Sequence: Synthetic oligonucleotide
cuugcaggauuucacaggg

SEQ ID NO: 401 - RNA, 19 nt, Artificial Sequence
  Description of Artificial Sequence: Synthetic oligonucleotide
ccuugcaggauuucacagg

SEQ ID NO: 402 - RNA, 19 nt, Artificial Sequence
  Description of Artificial Sequence: Synthetic oligonucleotide
acccccuugcaggauuuca

SEQ ID NO: 403 - RNA, 19 nt, Artificial Sequence
  Description of Artificial Sequence: Synthetic oligonucleotide
gcacccccuugcaggauuu

SEQ ID NO: 404 - RNA, 19 nt, Artificial Sequence
  Description of Artificial Sequence: Synthetic oligonucleotide
aaaaccugucccgcagguu

SEQ ID NO: 405 - RNA, 19 nt, Artificial Sequence
  Description of Artificial Sequence: Synthetic oligonucleotide
caaaaccugucccgcaggu

SEQ ID NO: 406 - RNA, 19 nt, Artificial Sequence
  Description of Artificial Sequence: Synthetic oligonucleotide
ccaaaaccugucccgcagg

SEQ ID NO: 407 - RNA, 19 nt, Artificial Sequence
  Description of Artificial Sequence: Synthetic oligonucleotide
gccaaaaccugucccgcag

SEQ ID NO: 408 - RNA, 19 nt, Artificial Sequence
  Description of Artificial Sequence: Synthetic oligonucleotide
aagccaaaaccugucccgc

SEQ ID NO: 409 - RNA, 19 nt, Artificial Sequence
  Description of Artificial Sequence: Synthetic oligonucleotide
caagccaaaaccugucccg

SEQ ID NO: 410 - RNA, 19 nt, Artificial Sequence
  Description of Artificial Sequence: Synthetic oligonucleotide
acaagccaaaaccuguccc

SEQ ID NO: 411 - RNA, 19 nt, Artificial Sequence
  Description of Artificial Sequence: Synthetic oligonucleotide
cacaagccaaaaccugucc

SEQ ID NO: 412 - RNA, 19 nt, Artificial Sequence
  Description of Artificial Sequence: Synthetic oligonucleotide
ucacaagccaaaaccuguc

SEQ ID NO: 413 - RNA, 19 nt, Artificial Sequence
  Description of Artificial Sequence: Synthetic oligonucleotide
aucacaagccaaaaccugu

SEQ ID NO: 414 - RNA, 19 nt, Artificial Sequence
  Description of Artificial Sequence: Synthetic oligonucleotide
gaucacaagccaaaaccug

SEQ ID NO: 415 - RNA, 19 nt, Artificial Sequence
  Description of Artificial Sequence: Synthetic oligonucleotide
ugaucacaagccaaaaccu

SEQ ID NO: 416 - RNA, 19 nt, Artificial Sequence
  Description of Artificial Sequence: Synthetic oligonucleotide
uugaucacaagccaaaacc

SEQ ID NO: 417 - RNA, 19 nt, Artificial Sequence
  Description of Artificial Sequence: Synthetic oligonucleotide
guugaucacaagccaaaac

SEQ ID NO: 418 - RNA, 19 nt, Artificial Sequence
  Description of Artificial Sequence: Synthetic oligonucleotide
ugguugaucacaagccaaa

SEQ ID NO: 419 - RNA, 19 nt, Artificial Sequence
  Description of Artificial Sequence: Synthetic oligonucleotide
cugguugaucacaagccaa

SEQ ID NO: 420 - RNA, 19 nt, Artificial Sequence
  Description of Artificial Sequence: Synthetic oligonucleotide
uccugguugaucacaagcc

SEQ ID NO: 421 - RNA, 19 nt, Artificial Sequence
  Description of Artificial Sequence: Synthetic oligonucleotide
cuccugguugaucacaagc

SEQ ID NO: 422 - RNA, 19 nt, Artificial Sequence
  Description of Artificial Sequence: Synthetic oligonucleotide
ccuccugguugaucacaag

SEQ ID NO: 423 - RNA, 19 nt, Artificial Sequence
  Description of Artificial Sequence: Synthetic oligonucleotide
cccuccugguugaucacaa

SEQ ID NO: 424 - RNA, 19 nt, Artificial Sequence
  Description of Artificial Sequence: Synthetic oligonucleotide
ucccuccugguugaucaca

SEQ ID NO: 425 - RNA, 19 nt, Artificial Sequence
  Description of Artificial Sequence: Synthetic oligonucleotide
uucccuccugguugaucac

SEQ ID NO: 426 - RNA, 19 nt, Artificial Sequence
  Description of Artificial Sequence: Synthetic oligonucleotide
uuucccuccugguugauca

SEQ ID NO: 427 - RNA, 19 nt, Artificial Sequence
  Description of Artificial Sequence: Synthetic oligonucleotide
uguuucccuccugguugau

SEQ ID NO: 428 - RNA, 19 nt, Artificial Sequence
  Description of Artificial Sequence: Synthetic oligonucleotide
auguuucccuccugguuga

SEQ ID NO: 429 - RNA, 19 nt, Artificial Sequence
  Description of Artificial Sequence: Synthetic oligonucleotide
cauguuucccuccugguug

SEQ ID NO: 430 - RNA, 19 nt, Artificial Sequence
  Description of Artificial Sequence: Synthetic oligonucleotide
ccauguuucccuccugguu

SEQ ID NO: 431 - RNA, 19 nt, Artificial Sequence
  Description of Artificial Sequence: Synthetic oligonucleotide
accauguuucccuccuggu

SEQ ID NO: 432 - RNA, 19 nt, Artificial Sequence
  Description of Artificial Sequence: Synthetic oligonucleotide
aaccauguuucccuccugg

SEQ ID NO: 433 - RNA, 19 nt, Artificial Sequence
  Description of Artificial Sequence: Synthetic oligonucleotide
uaaccauguuucccuccug

SEQ ID NO: 434 - RNA, 19 nt, Artificial Sequence
  Description of Artificial Sequence: Synthetic oligonucleotide
guaaccauguuucccuccu

SEQ ID NO: 435 - RNA, 19 nt, Artificial Sequence
  Description of Artificial Sequence: Synthetic oligonucleotide
aguaaccauguuucccucc

SEQ ID NO: 436 - RNA, 19 nt, Artificial Sequence
  Description of Artificial Sequence: Synthetic oligonucleotide
caguaaccauguuucccuc

SEQ ID NO: 437 - RNA, 19 nt, Artificial Sequence
  Description of Artificial Sequence: Synthetic oligonucleotide
agcaguaaccauguuuccc

SEQ ID NO: 438 - RNA, 19 nt, Artificial Sequence
  Description of Artificial Sequence: Synthetic oligonucleotide
gagcaguaaccauguuucc

SEQ ID NO: 439 - RNA, 19 nt, Artificial Sequence
  Description of Artificial Sequence: Synthetic oligonucleotide
cgagcaguaaccauguuuc

SEQ ID NO: 440 - RNA, 19 nt, Artificial Sequence
  Description of Artificial Sequence: Synthetic oligonucleotide
gcgagcaguaaccauguuu

SEQ ID NO: 441 - RNA, 19 nt, Artificial Sequence
  Description of Artificial Sequence: Synthetic oligonucleotide
ggcgagcaguaaccauguu

SEQ ID NO: 442 - RNA, 19 nt, Artificial Sequence
  Description of Artificial Sequence: Synthetic oligonucleotide
uggcgagcaguaaccaugu

SEQ ID NO: 443 - RNA, 19 nt, Artificial Sequence
  Description of Artificial Sequence: Synthetic oligonucleotide
cuggcgagcaguaaccaug

SEQ ID NO: 444 - RNA, 19 nt, Artificial Sequence
  Description of Artificial Sequence: Synthetic oligonucleotide
uuccuggcgagcaguaacc

SEQ ID NO: 445 - RNA, 19 nt, Artificial Sequence
  Description of Artificial Sequence: Synthetic oligonucleotide
accaggcgagguuccuggc

SEQ ID NO: 446 - RNA, 19 nt, Artificial Sequence
  Description of Artificial Sequence: Synthetic oligonucleotide
aggaccaggcgagguuccu

SEQ ID NO: 447 - RNA, 19 nt, Artificial Sequence
  Description of Artificial Sequence: Synthetic oligonucleotide
aaaucaggaccaggcgagg

SEQ ID NO: 448 - RNA, 19 nt, Artificial Sequence
  Description of Artificial Sequence: Synthetic oligonucleotide
gaaaucaggaccaggcgag

SEQ ID NO: 449 - RNA, 19 nt, Artificial Sequence
  Description of Artificial Sequence: Synthetic oligonucleotide
agggaaaucaggaccaggc

SEQ ID NO: 450 - RNA, 19 nt, Artificial Sequence
  Description of Artificial Sequence: Synthetic oligonucleotide
ucagggaaaucaggaccag

SEQ ID NO: 451 - RNA, 19 nt, Artificial Sequence
  Description of Artificial Sequence: Synthetic oligonucleotide
gucagggaaaucaggacca

SEQ ID NO: 452 - RNA, 19 nt, Artificial Sequence
  Description of Artificial Sequence: Synthetic oligonucleotide
aggucagggaaaucaggac

SEQ ID NO: 453 - RNA, 19 nt, Artificial Sequence
  Description of Artificial Sequence: Synthetic oligonucleotide
gcaggucagggaaaucagg

SEQ ID NO: 454 - RNA, 19 nt, Artificial Sequence
  Description of Artificial Sequence: Synthetic oligonucleotide
ugucaccaucgcaggucag

SEQ ID NO: 455 - RNA, 19 nt, Artificial Sequence
  Description of Artificial Sequence: Synthetic oligonucleotide
agggugucaccaucgcagg

SEQ ID NO: 456 - RNA, 19 nt, Artificial Sequence
  Description of Artificial Sequence: Synthetic oligonucleotide
ucagggugucaccaucgca

SEQ ID NO: 457 - RNA, 19 nt, Artificial Sequence
  Description of Artificial Sequence: Synthetic oligonucleotide
gucagggugucaccaucgc

SEQ ID NO: 458 - RNA, 19 nt, Artificial Sequence
  Description of Artificial Sequence: Synthetic oligonucleotide
agucagggugucaccaucg

SEQ ID NO: 459 - RNA, 19 nt, Artificial Sequence
  Description of Artificial Sequence: Synthetic oligonucleotide
gagucagggugucaccauc

SEQ ID NO: 460 - RNA, 19 nt, Artificial Sequence
  Description of Artificial Sequence: Synthetic oligonucleotide
agagucagggugucaccau

SEQ ID NO: 461 - RNA, 19 nt, Artificial Sequence
  Description of Artificial Sequence: Synthetic oligonucleotide
gagagucagggugucacca

SEQ ID NO: 462 - RNA, 19 nt, Artificial Sequence
  Description of Artificial Sequence: Synthetic oligonucleotide
ugagagucagggugucacc

SEQ ID NO: 463 - RNA, 19 nt, Artificial Sequence
  Description of Artificial Sequence: Synthetic oligonucleotide
cugagagucagggugucac

SEQ ID NO: 464 - RNA, 19 nt, Artificial Sequence
  Description of Artificial Sequence: Synthetic oligonucleotide
acugagagucaggguguca

SEQ ID NO: 465 - RNA, 19 nt, Artificial Sequence
  Description of Artificial Sequence: Synthetic oligonucleotide
cacugagagucaggguguc

SEQ ID NO: 466 - RNA, 19 nt, Artificial Sequence
  Description of Artificial Sequence: Synthetic oligonucleotide
gcacugagagucagggugu

SEQ ID NO: 467 - RNA, 19 nt, Artificial Sequence
  Description of Artificial Sequence: Synthetic oligonucleotide
ugcacugagagucagggug

SEQ ID NO: 468 - RNA, 19 nt, Artificial Sequence
  Description of Artificial Sequence: Synthetic oligonucleotide
cugcacugagagucagggu

SEQ ID NO: 469 - RNA, 19 nt, Artificial Sequence
  Description of Artificial Sequence: Synthetic oligonucleotide
gcugcacugagagucaggg

SEQ ID NO: 470 - RNA, 19 nt, Artificial Sequence
  Description of Artificial Sequence: Synthetic oligonucleotide
ggcugcacugagagucagg

SEQ ID NO: 471 - RNA, 19 nt, Artificial Sequence
  Description of Artificial Sequence: Synthetic oligonucleotide
aggcugcacugagagucag

SEQ ID NO: 472 - RNA, 19 nt, Artificial Sequence
  Description of Artificial Sequence: Synthetic oligonucleotide
uaggcugcacugagaguca

SEQ ID NO: 473 - RNA, 19 nt, Artificial Sequence
  Description of Artificial Sequence: Synthetic oligonucleotide
guaggcugcacugagaguc

SEQ ID NO: 474 - RNA, 19 nt, Artificial Sequence
  Description of Artificial Sequence: Synthetic oligonucleotide
uguaggcugcacugagagu

SEQ ID NO: 475 - RNA, 19 nt, Artificial Sequence
  Description of Artificial Sequence: Synthetic oligonucleotide
guguaggcugcacugagag

SEQ ID NO: 476 - RNA, 19 nt, Artificial Sequence
  Description of Artificial Sequence: Synthetic oligonucleotide
uguguaggcugcacugaga

SEQ ID NO: 477 - RNA, 19 nt, Artificial Sequence
  Description of Artificial Sequence: Synthetic oligonucleotide
uuuguguaggcugcacuga

SEQ ID NO: 478 - RNA, 19 nt, Artificial Sequence
  Description of Artificial Sequence: Synthetic oligonucleotide
cuuuguguaggcugcacug

SEQ ID NO: 479 - RNA, 19 nt, Artificial Sequence
  Description of Artificial Sequence: Synthetic oligonucleotide
ccuuuguguaggcugcacu

SEQ ID NO: 480 - RNA, 19 nt, Artificial Sequence
  Description of Artificial Sequence: Synthetic oligonucleotide
uccuuuguguaggcugcac

SEQ ID NO: 481 - RNA, 19 nt, Artificial Sequence
  Description of Artificial Sequence: Synthetic oligonucleotide
guccuuuguguaggcugca

SEQ ID NO: 482 - RNA, 19 nt, Artificial Sequence
  Description of Artificial Sequence: Synthetic oligonucleotide
gguccuuuguguaggcugc

SEQ ID NO: 483 - RNA, 19 nt, Artificial Sequence
  Description of Artificial Sequence: Synthetic oligonucleotide
agguccuuuguguaggcug

SEQ ID NO: 484 - RNA, 19 nt, Artificial Sequence
  Description of Artificial Sequence: Synthetic oligonucleotide
uagguccuuuguguaggcu

SEQ ID NO: 485 - RNA, 19 nt, Artificial Sequence
  Description of Artificial Sequence: Synthetic oligonucleotide
guagguccuuuguguaggc

SEQ ID NO: 486 - RNA, 19 nt, Artificial Sequence
  Description of Artificial Sequence: Synthetic oligonucleotide
aguaguagguccuuugugu

SEQ ID NO: 487 - RNA, 19 nt, Artificial Sequence
  Description of Artificial Sequence: Synthetic oligonucleotide
caguaguagguccuuugug

SEQ ID NO: 488 - RNA, 19 nt, Artificial Sequence
  Description of Artificial Sequence: Synthetic oligonucleotide
gcaguaguagguccuuugu

SEQ ID NO: 489 - RNA, 19 nt, Artificial Sequence
  Description of Artificial Sequence: Synthetic oligonucleotide
ggcaguaguagguccuuug

SEQ ID NO: 490 - RNA, 19 nt, Artificial Sequence
  Description of Artificial Sequence: Synthetic oligonucleotide
aggcaguaguagguccuuu

SEQ ID NO: 491 - RNA, 19 nt, Artificial Sequence
  Description of Artificial Sequence: Synthetic oligonucleotide
uaggcaguaguagguccuu

SEQ ID NO: 492 - RNA, 19 nt, Artificial Sequence
  Description of Artificial Sequence: Synthetic oligonucleotide
auaggcaguaguagguccu

SEQ ID NO: 493 - RNA, 19 nt, Artificial Sequence
  Description of Artificial Sequence: Synthetic oligonucleotide
gauaggcaguaguaggucc

SEQ ID NO: 494 - RNA, 19 nt, Artificial Sequence
  Description of Artificial Sequence: Synthetic oligonucleotide
ugauaggcaguaguagguc

SEQ ID NO: 495 - RNA, 19 nt, Artificial Sequence
  Description of Artificial Sequence: Synthetic oligonucleotide
uugauaggcaguaguaggu

SEQ ID NO: 496 - RNA, 19 nt, Artificial Sequence
  Description of Artificial Sequence: Synthetic oligonucleotide
uuuugauaggcaguaguag

SEQ ID NO: 497 - RNA, 19 nt, Artificial Sequence
  Description of Artificial Sequence: Synthetic oligonucleotide
guuuugauaggcaguagua

SEQ ID NO: 498 - RNA, 19 nt, Artificial Sequence
  Description of Artificial Sequence: Synthetic oligonucleotide
cguuuugauaggcaguagu

SEQ ID NO: 499 - RNA, 19 nt, Artificial Sequence
  Description of Artificial Sequence: Synthetic oligonucleotide
gcguuuugauaggcaguag

SEQ ID NO: 500 - RNA, 19 nt, Artificial Sequence
  Description of Artificial Sequence: Synthetic oligonucleotide
ggcguuuugauaggcagua

SEQ ID NO: 501 - RNA, 19 nt, Artificial Sequence
  Description of Artificial Sequence: Synthetic oligonucleotide
ugggcguuuugauaggcag

SEQ ID NO: 502 - RNA, 19 nt, Artificial Sequence
  Description of Artificial Sequence: Synthetic oligonucleotide
uuguggugggcguuuugau

SEQ ID NO: 503 - RNA, 19 nt, Artificial Sequence
  Description of Artificial Sequence: Synthetic oligonucleotide
uuuguggugggcguuuuga

SEQ ID NO: 504 - RNA, 19 nt, Artificial Sequence
  Description of Artificial Sequence: Synthetic oligonucleotide
auuuguggugggcguuuug

SEQ ID NO: 505 - RNA, 19 nt, Artificial Sequence
  Description of Artificial Sequence: Synthetic oligonucleotide
cauuuguggugggcguuuu

SEQ ID NO: 506 - RNA, 19 nt, Artificial Sequence
  Description of Artificial Sequence: Synthetic oligonucleotide
ugcauuuguggugggcguu

SEQ ID NO: 507 - RNA, 19 nt, Artificial Sequence
  Description of Artificial Sequence: Synthetic oligonucleotide
acugcauuuguggugggcg

SEQ ID NO: 508 - RNA, 19 nt, Artificial Sequence
  Description of Artificial Sequence: Synthetic oligonucleotide
cacugcauuuguggugggc

SEQ ID NO: 509 - RNA, 19 nt, Artificial Sequence
  Description of Artificial Sequence: Synthetic oligonucleotide
cuugugcacugcauuugug

SEQ ID NO: 510 - RNA, 19 nt, Artificial Sequence
  Description of Artificial Sequence: Synthetic oligonucleotide
acuugugcacugcauuugu

SEQ ID NO: 511 - RNA, 19 nt, Artificial Sequence
  Description of Artificial Sequence: Synthetic oligonucleotide
cacuugugcacugcauuug

SEQ ID NO: 512 - RNA, 19 nt, Artificial Sequence
  Description of Artificial Sequence: Synthetic oligonucleotide
agcugguuauccacugggc

SEQ ID NO: 513 - RNA, 19 nt, Artificial Sequence
  Description of Artificial Sequence: Synthetic oligonucleotide
aagcugguuauccacuggg

SEQ ID NO: 514 - RNA, 19 nt, Artificial Sequence
  Description of Artificial Sequence: Synthetic oligonucleotide
gaagcugguuauccacugg

SEQ ID NO: 515 - RNA, 19 nt, Artificial Sequence
  Description of Artificial Sequence: Synthetic oligonucleotide
ggaagcugguuauccacug

SEQ ID NO: 516 - RNA, 19 nt, Artificial Sequence
  Description of Artificial Sequence: Synthetic oligonucleotide
aggaagcugguuauccacu

SEQ ID NO: 517 - RNA, 19 nt, Artificial Sequence
  Description of Artificial Sequence: Synthetic oligonucleotide
caggaagcugguuauccac

SEQ ID NO: 518 - RNA, 19 nt, Artificial Sequence
  Description of Artificial Sequence: Synthetic oligonucleotide
ucaggaagcugguuaucca

SEQ ID NO: 519 - RNA, 19 nt, Artificial Sequence
  Description of Artificial Sequence: Synthetic oligonucleotide
uucaggaagcugguuaucc

SEQ ID NO: 520 - RNA, 19 nt, Artificial Sequence
  Description of Artificial Sequence: Synthetic oligonucleotide
cuucaggaagcugguuauc

SEQ ID NO: 521 - RNA, 19 nt, Artificial Sequence
  Description of Artificial Sequence: Synthetic oligonucleotide
acuucaggaagcugguuau

SEQ ID NO: 522 - RNA, 19 nt, Artificial Sequence
  Description of Artificial Sequence: Synthetic oligonucleotide
gacuucaggaagcugguua

SEQ ID NO: 523 - RNA, 19 nt, Artificial Sequence
  Description of Artificial Sequence: Synthetic oligonucleotide
ugacuucaggaagcugguu

SEQ ID NO: 524 - RNA, 19 nt, Artificial Sequence
  Description of Artificial Sequence: Synthetic oligonucleotide
gugacuucaggaagcuggu

SEQ ID NO: 525 - RNA, 19 nt, Artificial Sequence
  Description of Artificial Sequence: Synthetic oligonucleotide
ugugacuucaggaagcugg

SEQ ID NO: 526 - RNA, 19 nt, Artificial Sequence
  Description of Artificial Sequence: Synthetic oligonucleotide
cugugacuucaggaagcug

SEQ ID NO: 527 - RNA, 19 nt, Artificial Sequence
  Description of Artificial Sequence: Synthetic oligonucleotide
gcugugacuucaggaagcu

SEQ ID NO: 528 - RNA, 19 nt, Artificial Sequence
  Description of Artificial Sequence: Synthetic oligonucleotide
ggcugugacuucaggaagc

SEQ ID NO: 529 - RNA, 19 nt, Artificial Sequence
  Description of Artificial Sequence: Synthetic oligonucleotide
ucgaagugcaccaggcggu

SEQ ID NO: 530 - RNA, 19 nt, Artificial Sequence
  Description of Artificial Sequence: Synthetic oligonucleotide
gcucgaagugcaccaggcg

SEQ ID NO: 531 - RNA, 19 nt, Artificial Sequence
  Description of Artificial Sequence: Synthetic oligonucleotide
ggcucgaagugcaccaggc

SEQ ID NO: 532 - RNA, 19 nt, Artificial Sequence
  Description of Artificial Sequence: Synthetic oligonucleotide
aggcucgaagugcaccagg

SEQ ID NO: 533 - RNA, 19 nt, Artificial Sequence
  Description of Artificial Sequence: Synthetic oligonucleotide
ugugaggcucgaagugcac

SEQ ID NO: 534 - RNA, 19 nt, Artificial Sequence
  Description of Artificial Sequence: Synthetic oligonucleotide
gcaugugaggcucgaagug

SEQ ID NO: 535 - RNA, 19 nt, Artificial Sequence
  Description of Artificial Sequence: Synthetic oligonucleotide
gacgucucggucgcaugug

SEQ ID NO: 536 - RNA, 19 nt, Artificial Sequence
  Description of Artificial Sequence: Synthetic oligonucleotide
aggacgucucggucgcaug

SEQ ID NO: 537 - RNA, 19 nt, Artificial Sequence
  Description of Artificial Sequence: Synthetic oligonucleotide
augaggacgucucggucgc

SEQ ID NO: 538 - RNA, 19 nt, Artificial Sequence
  Description of Artificial Sequence: Synthetic oligonucleotide
gaugaggacgucucggucg

SEQ ID NO: 539 - RNA, 19 nt, Artificial Sequence
  Description of Artificial Sequence: Synthetic oligonucleotide
uugaugaggacgucucggu

SEQ ID NO: 540 - RNA, 19 nt, Artificial Sequence
  Description of Artificial Sequence: Synthetic oligonucleotide
uuugaugaggacgucucgg

SEQ ID NO: 541 - RNA, 19 nt, Artificial Sequence
  Description of Artificial Sequence: Synthetic oligonucleotide
auuugaugaggacgucucg

SEQ ID NO: 542 - RNA, 19 nt, Artificial Sequence
  Description of Artificial Sequence: Synthetic oligonucleotide
uauuugaugaggacgucuc

SEQ ID NO: 543 - RNA, 19 nt, Artificial Sequence
  Description of Artificial Sequence: Synthetic oligonucleotide
cuauuugaugaggacgucu

SEQ ID NO: 544 - RNA, 19 nt, Artificial Sequence
  Description of Artificial Sequence: Synthetic oligonucleotide
gcuauuugaugaggacguc

SEQ ID NO: 545 - RNA, 19 nt, Artificial Sequence
  Description of Artificial Sequence: Synthetic oligonucleotide
ugcuauuugaugaggacgu

SEQ ID NO: 546 - RNA, 19 nt, Artificial Sequence
  Description of Artificial Sequence: Synthetic oligonucleotide
cugcuauuugaugaggacg

SEQ ID NO: 547 - RNA, 19 nt, Artificial Sequence
  Description of Artificial Sequence: Synthetic oligonucleotide
ucugcuauuugaugaggac

SEQ ID NO: 548 - RNA, 19 nt, Artificial Sequence
  Description of Artificial Sequence: Synthetic oligonucleotide
gucugcuauuugaugagga

SEQ ID NO: 549 - RNA, 19 nt, Artificial Sequence
  Description of Artificial Sequence: Synthetic oligonucleotide
agucugcuauuugaugagg

SEQ ID NO: 550 - RNA, 19 nt, Artificial Sequence
  Description of Artificial Sequence: Synthetic oligonucleotide
aagucugcuauuugaugag

SEQ ID NO: 551 - RNA, 19 nt, Artificial Sequence
  Description of Artificial Sequence: Synthetic oligonucleotide
caagucugcuauuugauga

SEQ ID NO: 552 - RNA, 19 nt, Artificial Sequence
  Description of Artificial Sequence: Synthetic oligonucleotide
acaagucugcuauuugaug

SEQ ID NO: 553 - RNA, 19 nt, Artificial Sequence
  Description of Artificial Sequence: Synthetic oligonucleotide
aacaagucugcuauuugau

SEQ ID NO: 554 - RNA, 19 nt, Artificial Sequence
  Description of Artificial Sequence: Synthetic oligonucleotide
gaacaagucugcuauuuga

SEQ ID NO: 555 - RNA, 19 nt, Artificial Sequence
  Description of Artificial Sequence: Synthetic oligonucleotide
ggaacaagucugcuauuug

SEQ ID NO: 556 - RNA, 19 nt, Artificial Sequence
  Description of Artificial Sequence: Synthetic oligonucleotide
cggaacaagucugcuauuu

SEQ ID NO: 557 - RNA, 19 nt, Artificial Sequence
  Description of Artificial Sequence: Synthetic oligonucleotide
ucggaacaagucugcuauu

SEQ ID NO: 558 - RNA, 19 nt, Artificial Sequence
  Description of Artificial Sequence: Synthetic oligonucleotide
gucggaacaagucugcuau

SEQ ID NO: 559 - RNA, 19 nt, Artificial Sequence
  Description of Artificial Sequence: Synthetic oligonucleotide
ggucggaacaagucugcua

SEQ ID NO: 560 - RNA, 19 nt, Artificial Sequence
  Description of Artificial Sequence: Synthetic oligonucleotide
gggucggaacaagucugcu

SEQ ID NO: 561 - RNA, 19 nt, Artificial Sequence
  Description of Artificial Sequence: Synthetic oligonucleotide
ugggucggaacaagucugc

SEQ ID NO: 562 - RNA, 19 nt, Artificial Sequence
  Description of Artificial Sequence: Synthetic oligonucleotide
uugggucggaacaagucug

SEQ ID NO: 563 - RNA, 19 nt, Artificial Sequence
  Description of Artificial Sequence: Synthetic oligonucleotide
cuugggucggaacaagucu

SEQ ID NO: 564 - RNA, 19 nt, Artificial Sequence
  Description of Artificial Sequence: Synthetic oligonucleotide
ccuugggucggaacaaguc

SEQ ID NO: 565 - RNA, 19 nt, Artificial Sequence
  Description of Artificial Sequence: Synthetic oligonucleotide
uccuugggucggaacaagu

SEQ ID NO: 566 - RNA, 19 nt, Artificial Sequence
  Description of Artificial Sequence: Synthetic oligonucleotide
guccuugggucggaacaag

SEQ ID NO: 567 - RNA, 19 nt, Artificial Sequence
  Description of Artificial Sequence: Synthetic oligonucleotide
gguccuugggucggaacaa

SEQ ID NO: 568 - RNA, 19 nt, Artificial Sequence
  Description of Artificial Sequence: Synthetic oligonucleotide
ugguccuugggucggaaca

SEQ ID NO: 569 - RNA, 19 nt, Artificial Sequence
  Description of Artificial Sequence: Synthetic oligonucleotide
cugguccuugggucggaac

SEQ ID NO: 570 - RNA, 19 nt, Artificial Sequence
  Description of Artificial Sequence: Synthetic oligonucleotide
ucugguccuugggucggaa

SEQ ID NO: 571 - RNA, 19 nt, Artificial Sequence
  Description of Artificial Sequence: Synthetic oligonucleotide
aucugguccuugggucgga

SEQ ID NO: 572 - RNA, 19 nt, Artificial Sequence
  Description of Artificial Sequence: Synthetic oligonucleotide
aaucugguccuugggucgg

SEQ ID NO: 573 - RNA, 19 nt, Artificial Sequence
  Description of Artificial Sequence: Synthetic oligonucleotide
caaucugguccuugggucg

SEQ ID NO: 574 - RNA, 19 nt, Artificial Sequence
  Description of Artificial Sequence: Synthetic oligonucleotide
gcaaucugguccuuggguc

SEQ ID NO: 575 - RNA, 19 nt, Artificial Sequence
  Description of Artificial Sequence: Synthetic oligonucleotide
agcaaucugguccuugggu

SEQ ID NO: 576 - RNA, 19 nt, Artificial Sequence
  Description of Artificial Sequence: Synthetic oligonucleotide
aagcaaucugguccuuggg

SEQ ID NO: 577 - RNA, 19 nt, Artificial Sequence
  Description of Artificial Sequence: Synthetic oligonucleotide
uaagcaaucugguccuugg

SEQ ID NO: 578 - RNA, 19 nt, Artificial Sequence
  Description of Artificial Sequence: Synthetic oligonucleotide
guaagcaaucugguccuug

SEQ ID NO: 579 - RNA, 19 nt, Artificial Sequence
  Description of Artificial Sequence: Synthetic oligonucleotide
aguaagcaaucugguccuu

SEQ ID NO: 580 - RNA, 19 nt, Artificial Sequence
  Description of Artificial Sequence: Synthetic oligonucleotide
gaguaagcaaucugguccu

SEQ ID NO: 581 - RNA, 19 nt, Artificial Sequence
  Description of Artificial Sequence: Synthetic oligonucleotide
ugaguaagcaaucuggucc

SEQ ID NO: 582 - RNA, 19 nt, Artificial Sequence
  Description of Artificial Sequence: Synthetic oligonucleotide
cugaguaagcaaucugguc

SEQ ID NO: 583 - RNA, 19 nt, Artificial Sequence
  Description of Artificial Sequence: Synthetic oligonucleotide
ucugaguaagcaaucuggu

SEQ ID NO: 584 - RNA, 19 nt, Artificial Sequence
  Description of Artificial Sequence: Synthetic oligonucleotide
gucugaguaagcaaucugg

SEQ ID NO: 585 - RNA, 19 nt, Artificial Sequence
  Description of Artificial Sequence: Synthetic oligonucleotide
ugucugaguaagcaaucug

SEQ ID NO: 586 - RNA, 19 nt, Artificial Sequence
  Description of Artificial Sequence: Synthetic oligonucleotide
gugucugaguaagcaaucu

SEQ ID NO: 587 - RNA, 19 nt, Artificial Sequence
  Description of Artificial Sequence: Synthetic oligonucleotide
ggugucugaguaagcaauc

SEQ ID NO: 588 - RNA, 19 nt, Artificial Sequence
  Description of Artificial Sequence: Synthetic oligonucleotide
uggugucugaguaagcaau

SEQ ID NO: 589 - RNA, 19 nt, Artificial Sequence
  Description of Artificial Sequence: Synthetic oligonucleotide
cuggugucugaguaagcaa

SEQ ID NO: 590 - RNA, 19 nt, Artificial Sequence
  Description of Artificial Sequence: Synthetic oligonucleotide
gcuggugucugaguaagca

SEQ ID NO: 591 - RNA, 19 nt, Artificial Sequence
  Description of Artificial Sequence: Synthetic oligonucleotide
ggcuggugucugaguaagc

SEQ ID NO: 592 - RNA, 19 nt, Artificial Sequence
  Description of Artificial Sequence: Synthetic oligonucleotide
gggcuggugucugaguaag

SEQ ID NO: 593 - RNA, 19 nt, Artificial Sequence
  Description of Artificial Sequence: Synthetic oligonucleotide
ugggcuggugucugaguaa

SEQ ID NO: 594 - RNA, 19 nt, Artificial Sequence
  Description of Artificial Sequence: Synthetic oligonucleotide
augggcuggugucugagua

SEQ ID NO: 595 - RNA, 19 nt, Artificial Sequence
  Description of Artificial Sequence: Synthetic oligonucleotide
aaugggcuggugucugagu

SEQ ID NO: 596 - RNA, 19 nt, Artificial Sequence
  Description of Artificial Sequence: Synthetic oligonucleotide
gaaugggcuggugucugag

SEQ ID NO: 597 - RNA, 19 nt, Artificial Sequence
  Description of Artificial Sequence: Synthetic oligonucleotide
agaaugggcuggugucuga

SEQ ID NO: 598 - RNA, 19 nt, Artificial Sequence
  Description of Artificial Sequence: Synthetic oligonucleotide
aagaaugggcuggugucug

SEQ ID NO: 599 - RNA, 19 nt, Artificial Sequence
  Description of Artificial Sequence: Synthetic oligonucleotide
caagaaugggcuggugucu

SEQ ID NO: 600 - RNA, 19 nt, Artificial Sequence
  Description of Artificial Sequence: Synthetic oligonucleotide
ucaagaaugggcugguguc

SEQ ID NO: 601 - RNA, 19 nt, Artificial Sequence
  Description of Artificial Sequence: Synthetic oligonucleotide
aucaagaaugggcuggugu

SEQ ID NO: 602 - RNA, 19 nt, Artificial Sequence
  Description of Artificial Sequence: Synthetic oligonucleotide
gaucaagaaugggcuggug

SEQ ID NO: 603 - RNA, 19 nt, Artificial Sequence
  Description of Artificial Sequence: Synthetic oligonucleotide
ggaucaagaaugggcuggu

SEQ ID NO: 604 - RNA, 19 nt, Artificial Sequence
  Description of Artificial Sequence: Synthetic oligonucleotide
aggaucaagaaugggcugg

SEQ ID NO: 605 - RNA, 19 nt, Artificial Sequence
  Description of Artificial Sequence: Synthetic oligonucleotide
aaggaucaagaaugggcug

SEQ ID NO: 606 - RNA, 19 nt, Artificial Sequence
  Description of Artificial Sequence: Synthetic oligonucleotide
aaaggaucaagaaugggcu

SEQ ID NO: 607 - RNA, 19 nt, Artificial Sequence
  Description of Artificial Sequence: Synthetic oligonucleotide
ucagaaaggaucaagaaug

SEQ ID NO: 608 - RNA, 19 nt, Artificial Sequence
  Description of Artificial Sequence: Synthetic oligonucleotide
cucagaaaggaucaagaau

SEQ ID NO: 609 - RNA, 19 nt, Artificial Sequence
  Description of Artificial Sequence: Synthetic oligonucleotide
ucuagccuggaguugagau

SEQ ID NO: 610 - RNA, 19 nt, Artificial Sequence
  Description of Artificial Sequence: Synthetic oligonucleotide
ucucuagccuggaguugag

SEQ ID NO: 611 - RNA, 19 nt, Artificial Sequence
  Description of Artificial Sequence: Synthetic oligonucleotide
cuucucuagccuggaguug

SEQ ID NO: 612 - RNA, 19 nt, Artificial Sequence
  Description of Artificial Sequence: Synthetic oligonucleotide
ucuucucuagccuggaguu

SEQ ID NO: 613 - RNA, 19 nt, Artificial Sequence
  Description of Artificial Sequence: Synthetic oligonucleotide
uucuucucuagccuggagu

SEQ ID NO: 614 - RNA, 19 nt, Artificial Sequence
  Description of Artificial Sequence: Synthetic oligonucleotide
uuucuucucuagccuggag

SEQ ID NO: 615 - RNA, 19 nt, Artificial Sequence
  Description of Artificial Sequence: Synthetic oligonucleotide
acuuucuucucuagccugg

SEQ ID NO: 616 - RNA, 19 nt, Artificial Sequence
  Description of Artificial Sequence: Synthetic oligonucleotide
aacuuucuucucuagccug

SEQ ID NO: 617 - RNA, 19 nt, Artificial Sequence
  Description of Artificial Sequence: Synthetic oligonucleotide
uaacuuucuucucuagccu

SEQ ID NO: 618 - RNA, 19 nt, Artificial Sequence
  Description of Artificial Sequence: Synthetic oligonucleotide
uuaacuuucuucucuagcc

SEQ ID NO: 619 - RNA, 19 nt, Artificial Sequence
  Description of Artificial Sequence: Synthetic oligonucleotide
uuuaacuuucuucucuagc

SEQ ID NO: 620 - RNA, 19 nt, Artificial Sequence
  Description of Artificial Sequence: Synthetic oligonucleotide
cuuuaacuuucuucucuag

SEQ ID NO: 621 - RNA, 19 nt, Artificial Sequence
  Description of Artificial Sequence: Synthetic oligonucleotide
gcuuuaacuuucuucucua

SEQ ID NO: 622 - RNA, 19 nt, Artificial Sequence
  Description of Artificial Sequence: Synthetic oligonucleotide
ugcuuuaacuuucuucucu

SEQ ID NO: 623 - RNA, 19 nt, Artificial Sequence
  Description of Artificial Sequence: Synthetic oligonucleotide
uugcuuuaacuuucuucuc

SEQ ID NO: 624 - RNA, 19 nt, Artificial Sequence
  Description of Artificial Sequence: Synthetic oligonucleotide
guugcuuuaacuuucuucu

SEQ ID NO: 625 - RNA, 19 nt, Artificial Sequence
  Description of Artificial Sequence: Synthetic oligonucleotide
gguugcuuuaacuuucuuc

SEQ ID NO: 626 - RNA, 19 nt, Artificial Sequence
  Description of Artificial Sequence: Synthetic oligonucleotide
ugguugcuuuaacuuucuu

SEQ ID NO: 627 - RNA, 19 nt, Artificial Sequence
  Description of Artificial Sequence: Synthetic oligonucleotide
uugguugcuuuaacuuucu

SEQ ID NO: 628 - RNA, 19 nt, Artificial Sequence
  Description of Artificial Sequence: Synthetic oligonucleotide
guugguugcuuuaacuuuc

SEQ ID NO: 629 - RNA, 19 nt, Artificial Sequence
  Description of Artificial Sequence: Synthetic oligonucleotide
aguugguugcuuuaacuuu

SEQ ID NO: 630 - RNA, 19 nt, Artificial Sequence
  Description of Artificial Sequence: Synthetic oligonucleotide
aaguugguugcuuuaacuu

SEQ ID NO: 631 - RNA, 19 nt, Artificial Sequence
  Description of Artificial Sequence: Synthetic oligonucleotide
ugaaguugguugcuuuaac

SEQ ID NO: 632 - RNA, 19 nt, Artificial Sequence
  Description of Artificial Sequence: Synthetic oligonucleotide
cugaaguugguugcuuuaa

SEQ ID NO: 633 - RNA, 19 nt, Artificial Sequence
  Description of Artificial Sequence: Synthetic oligonucleotide
ccugaaguugguugcuuua

SEQ ID NO: 634 - RNA, 19 nt, Artificial Sequence
  Description of Artificial Sequence: Synthetic oligonucleotide
gccugaaguugguugcuuu

SEQ ID NO: 635 - RNA, 19 nt, Artificial Sequence
  Description of Artificial Sequence: Synthetic oligonucleotide
ggccugaaguugguugcuu

SEQ ID NO: 636 - RNA, 19 nt, Artificial Sequence
  Description of Artificial Sequence: Synthetic oligonucleotide
gggccugaaguugguugcu

SEQ ID NO: 637 - RNA, 19 nt, Artificial Sequence
  Description of Artificial Sequence: Synthetic oligonucleotide
ugggccugaaguugguugc

SEQ ID NO: 638 - RNA, 19 nt, Artificial Sequence
  Description of Artificial Sequence: Synthetic oligonucleotide
auugggccugaaguugguu

SEQ ID NO: 639 - RNA, 19 nt, Artificial Sequence
  Description of Artificial Sequence: Synthetic oligonucleotide
uauugggccugaaguuggu

SEQ ID NO: 640 - RNA, 19 nt, Artificial Sequence
  Description of Artificial Sequence: Synthetic oligonucleotide
auauugggccugaaguugg

SEQ ID NO: 641 - RNA, 19 nt, Artificial Sequence
  Description of Artificial Sequence: Synthetic oligonucleotide
aauauugggccugaaguug

SEQ ID NO: 642 - RNA, 19 nt, Artificial Sequence
  Description of Artificial Sequence: Synthetic oligonucleotide
caauauugggccugaaguu

SEQ ID NO: 643 - RNA, 19 nt, Artificial Sequence
  Description of Artificial Sequence: Synthetic oligonucleotide
acaauauugggccugaagu

SEQ ID NO: 644 - RNA, 19 nt, Artificial Sequence
  Description of Artificial Sequence: Synthetic oligonucleotide
uacaauauugggccugaag

SEQ ID NO: 645 - RNA, 19 nt, Artificial Sequence
  Description of Artificial Sequence: Synthetic oligonucleotide
uuacaauauugggccugaa

SEQ ID NO: 646 - RNA, 19 nt, Artificial Sequence
  Description of Artificial Sequence: Synthetic oligonucleotide
auuacaauauugggccuga

SEQ ID NO: 647 - RNA, 19 nt, Artificial Sequence
  Description of Artificial Sequence: Synthetic oligonucleotide
aauuacaauauugggccug

SEQ ID NO: 648 - RNA, 19 nt, Artificial Sequence
  Description of Artificial Sequence: Synthetic oligonucleotide
aaauuacaauauugggccu

SEQ ID NO: 649 - RNA, 19 nt, Artificial Sequence
  Description of Artificial Sequence: Synthetic oligonucleotide
gaaauuacaauauugggcc

SEQ ID NO: 650 - RNA, 19 nt, Artificial Sequence
  Description of Artificial Sequence: Synthetic oligonucleotide
ugaaauuacaauauugggc

SEQ ID NO: 651 - RNA, 19 nt, Artificial Sequence
  Description of Artificial Sequence: Synthetic oligonucleotide
cugaaauuacaauauuggg

SEQ ID NO: 652 - RNA, 19 nt, Artificial Sequence
  Description of Artificial Sequence: Synthetic oligonucleotide
ccugaaauuacaauauugg

SEQ ID NO: 653 - RNA, 19 nt, Artificial Sequence
  Description of Artificial Sequence: Synthetic oligonucleotide
uccugaaauuacaauauug

SEQ ID NO: 654 - RNA, 19 nt, Artificial Sequence
  Description of Artificial Sequence: Synthetic oligonucleotide
auccugaaauuacaauauu

SEQ ID NO: 655 - RNA, 19 nt, Artificial Sequence
  Description of Artificial Sequence: Synthetic oligonucleotide
cauccugaaauuacaauau

SEQ ID NO: 656 - RNA, 19 nt, Artificial Sequence
  Description of Artificial Sequence: Synthetic oligonucleotide
gcauccugaaauuacaaua

SEQ ID NO: 657 - RNA, 19 nt, Artificial Sequence
  Description of Artificial Sequence: Synthetic oligonucleotide
cgcauccugaaauuacaau

SEQ ID NO: 658 - RNA, 19 nt, Artificial Sequence
  Description of Artificial Sequence: Synthetic oligonucleotide
ucgcauccugaaauuacaa

SEQ ID NO: 659 - RNA, 19 nt, Artificial Sequence
  Description of Artificial Sequence: Synthetic oligonucleotide
aucgcauccugaaauuaca

SEQ ID NO: 660 - RNA, 19 nt, Artificial Sequence
  Description of Artificial Sequence: Synthetic oligonucleotide
caucgcauccugaaauuac

SEQ ID NO: 661 - RNA, 19 nt, Artificial Sequence
  Description of Artificial Sequence: Synthetic oligonucleotide
acaucgcauccugaaauua

SEQ ID NO: 662 - RNA, 19 nt, Artificial Sequence
  Description of Artificial Sequence: Synthetic oligonucleotide
gacaucgcauccugaaauu

SEQ ID NO: 663 - RNA, 19 nt, Artificial Sequence
  Description of Artificial Sequence: Synthetic oligonucleotide
agacaucgcauccugaaau

SEQ ID NO: 664 - RNA, 19 nt, Artificial Sequence
  Description of Artificial Sequence: Synthetic oligonucleotide
uagacaucgcauccugaaa

SEQ ID NO: 665 - RNA, 19 nt, Artificial Sequence
  Description of Artificial Sequence: Synthetic oligonucleotide
auagacaucgcauccugaa

SEQ ID NO: 666 - RNA, 19 nt, Artificial Sequence
  Description of Artificial Sequence: Synthetic oligonucleotide
cauagacaucgcauccuga

SEQ ID NO: 667 - RNA, 19 nt, Artificial Sequence
  Description of Artificial Sequence: Synthetic oligonucleotide
gcauagacaucgcauccug

SEQ ID NO: 668 - RNA, 19 nt, Artificial Sequence
  Description of Artificial Sequence: Synthetic oligonucleotide
ugcauagacaucgcauccu

SEQ ID NO: 669 - RNA, 19 nt, Artificial Sequence
  Description of Artificial Sequence: Synthetic oligonucleotide
cugcauagacaucgcaucc

SEQ ID NO: 670 - RNA, 19 nt, Artificial Sequence
  Description of Artificial Sequence: Synthetic oligonucleotide
ucugcauagacaucgcauc

SEQ ID NO: 671 - RNA, 19 nt, Artificial Sequence
  Description of Artificial Sequence: Synthetic oligonucleotide
cucugcauagacaucgcau

SEQ ID NO: 672 - RNA, 19 nt, Artificial Sequence
  Description of Artificial Sequence: Synthetic oligonucleotide
ccucugcauagacaucgca

SEQ ID NO: 673 - RNA, 19 nt, Artificial Sequence
  Description of Artificial Sequence: Synthetic oligonucleotide
uaaaaugcaucuggaacaa

SEQ ID NO: 674 - RNA, 19 nt, Artificial Sequence
  Description of Artificial Sequence: Synthetic oligonucleotide
auaacucuucaguguuucc

SEQ ID NO: 675 - RNA, 19 nt, Artificial Sequence
  Description of Artificial Sequence: Synthetic oligonucleotide
gauaacucuucaguguuuc

SEQ ID NO: 676 - RNA, 19 nt, Artificial Sequence
  Description of Artificial Sequence: Synthetic oligonucleotide
uggcgauaacucuucagug

SEQ ID NO: 677 - RNA, 19 nt, Artificial Sequence
  Description of Artificial Sequence: Synthetic oligonucleotide
uuucguucugaagggucac

SEQ ID NO: 678 - RNA, 19 nt, Artificial Sequence
  Description of Artificial Sequence: Synthetic oligonucleotide
uaacuuucguucugaaggg

SEQ ID NO: 679 - RNA, 19 nt, Artificial Sequence
  Description of Artificial Sequence: Synthetic oligonucleotide
auaacuuucguucugaagg

SEQ ID NO: 680 - RNA, 19 nt, Artificial Sequence
  Description of Artificial Sequence: Synthetic oligonucleotide
cauauaacuuucguucuga

SEQ ID NO: 681 - RNA, 19 nt, Artificial Sequence
  Description of Artificial Sequence: Synthetic oligonucleotide
ccauauaacuuucguucug

SEQ ID NO: 682 - RNA, 19 nt, Artificial Sequence
  Description of Artificial Sequence: Synthetic oligonucleotide
uccauauaacuuucguucu

SEQ ID NO: 683 - RNA, 19 nt, Artificial Sequence
  Description of Artificial Sequence: Synthetic oligonucleotide
uuccauauaacuuucguuc

SEQ ID NO: 684 - RNA, 19 nt, Artificial Sequence
  Description of Artificial Sequence: Synthetic oligonucleotide
uuuccauauaacuuucguu

SEQ ID NO: 685 - RNA, 19 nt, Artificial Sequence
  Description of Artificial Sequence: Synthetic oligonucleotide
auuuuccauauaacuuucg

SEQ ID NO: 686 - RNA, 19 nt, Artificial Sequence
  Description of Artificial Sequence: Synthetic oligonucleotide
gauuuuccauauaacuuuc

SEQ ID NO: 687 - RNA, 19 nt, Artificial Sequence
  Description of Artificial Sequence: Synthetic oligonucleotide
ugauuuuccauauaacuuu

SEQ ID NO: 688 - RNA, 19 nt, Artificial Sequence
  Description of Artificial Sequence: Synthetic oligonucleotide
cauuuuugagaacauuuuu

SEQ ID NO: 689 - RNA, 19 nt, Artificial Sequence
  Description of Artificial Sequence: Synthetic oligonucleotide
uguugucauuuuugagaac

SEQ ID NO: 690 - RNA, 19 nt, Artificial Sequence
  Description of Artificial Sequence: Synthetic oligonucleotide
ucaaguguugucauuuuug

SEQ ID NO: 691 - RNA, 19 nt, Artificial Sequence
  Description of Artificial Sequence: Synthetic oligonucleotide
augcuucaaguguugucau

SEQ ID NO: 692 - RNA, 19 nt, Artificial Sequence
  Description of Artificial Sequence: Synthetic oligonucleotide
accaugcuucaaguguugu

SEQ ID NO: 693 - RNA, 19 nt, Artificial Sequence
  Description of Artificial Sequence: Synthetic oligonucleotide
caccaugcuucaaguguug

SEQ ID NO: 694 - RNA, 19 nt, Artificial Sequence
  Description of Artificial Sequence: Synthetic oligonucleotide
acaccaugcuucaaguguu

SEQ ID NO: 695 - RNA, 19 nt, Artificial Sequence
  Description of Artificial Sequence: Synthetic oligonucleotide
aacaccaugcuucaagugu

SEQ ID NO: 696 - RNA, 19 nt, Artificial Sequence
  Description of Artificial Sequence: Synthetic oligonucleotide
aaacaccaugcuucaagug

SEQ ID NO: 697 - RNA, 19 nt, Artificial Sequence
  Description of Artificial Sequence: Synthetic oligonucleotide
ugaaacaccaugcuucaag

SEQ ID NO: 698 - RNA, 19 nt, Artificial Sequence
  Description of Artificial Sequence: Synthetic oligonucleotide
cugaaacaccaugcuucaa

SEQ ID NO: 699 - RNA, 19 nt, Artificial Sequence
  Description of Artificial Sequence: Synthetic oligonucleotide
ucugaaacaccaugcuuca

SEQ ID NO: 700 - RNA, 19 nt, Artificial Sequence
  Description of Artificial Sequence: Synthetic oligonucleotide
uucugaaacaccaugcuuc

SEQ ID NO: 701 - RNA, 19 nt, Artificial Sequence
  Description of Artificial Sequence: Synthetic oligonucleotide
ucaguucugaaacaccaug

SEQ ID NO: 702 - RNA, 19 nt, Artificial Sequence
  Description of Artificial Sequence: Synthetic oligonucleotide
aggucucaguucugaaaca

SEQ ID NO: 703 - RNA, 19 nt, Artificial Sequence
  Description of Artificial Sequence: Synthetic oligonucleotide
acaaauuuaaagaaaaugu

SEQ ID NO: 704 - RNA, 19 nt, Artificial Sequence
  Description of Artificial Sequence: Synthetic oligonucleotide
ucacaaauuuaaagaaaau

SEQ ID NO: 705 - RNA, 19 nt, Artificial Sequence
  Description of Artificial Sequence: Synthetic oligonucleotide
ugaaaaucacaaauuuaaa

SEQ ID NO: 706 - RNA, 19 nt, Artificial Sequence
  Description of Artificial Sequence: Synthetic oligonucleotide
aaugugaaaaucacaaauu

SEQ ID NO: 707 - RNA, 19 nt, Artificial Sequence
  Description of Artificial Sequence: Synthetic oligonucleotide
aaaaugugaaaaucacaaa

SEQ ID NO: 708 - RNA, 19 nt, Artificial Sequence
  Description of Artificial Sequence: Synthetic oligonucleotide
auuccauaaucaguuaaac

SEQ ID NO: 709 - RNA, 19 nt, Artificial Sequence
  Description of Artificial Sequence: Synthetic oligonucleotide
uauuccauaaucaguuaaa

SEQ ID NO: 710 - RNA, 19 nt, Artificial Sequence
  Description of Artificial Sequence: Synthetic oligonucleotide
acuauuccauaaucaguua

SEQ ID NO: 711 - RNA, 19 nt, Artificial Sequence
  Description of Artificial Sequence: Synthetic oligonucleotide
aacuauuccauaaucaguu

SEQ ID NO: 712 - RNA, 19 nt, Artificial Sequence
  Description of Artificial Sequence: Synthetic oligonucleotide
gaacuauuccauaaucagu

SEQ ID NO: 713 - RNA, 19 nt, Artificial Sequence
  Description of Artificial Sequence: Synthetic oligonucleotide
agaacuauuccauaaucag

SEQ ID NO: 714 - RNA, 19 nt, Artificial Sequence
  Description of Artificial Sequence: Synthetic oligonucleotide
uauggaaaauuaauaucug

SEQ ID NO: 715 - RNA, 19 nt, Artificial Sequence
  Description of Artificial Sequence: Synthetic oligonucleotide
ucuauggaaaauuaauauc

SEQ ID NO: 716 - RNA, 19 nt, Artificial Sequence
  Description of Artificial Sequence: Synthetic oligonucleotide
uccaaugcugucugagaag

SEQ ID NO: 717 - RNA, 19 nt, Artificial Sequence
  Description of Artificial Sequence: Synthetic oligonucleotide
aaauccaaugcugucugag

SEQ ID NO: 718 - RNA, 19 nt, Artificial Sequence
  Description of Artificial Sequence: Synthetic oligonucleotide
gaaauccaaugcugucuga

SEQ ID NO: 719 - RNA, 19 nt, Artificial Sequence
  Description of Artificial Sequence: Synthetic oligonucleotide
aucacugaaucacuuuucu

SEQ ID NO: 720 - RNA, 19 nt, Artificial Sequence
  Description of Artificial Sequence: Synthetic oligonucleotide
ugaaaucacugaaucacuu

SEQ ID NO: 721 - RNA, 19 nt, Artificial Sequence
  Description of Artificial Sequence: Synthetic oligonucleotide
caacugacauaugcuuucc

SEQ ID NO: 722 - RNA, 19 nt, Artificial Sequence
  Description of Artificial Sequence: Synthetic oligonucleotide
acaacugacauaugcuuuc

SEQ ID NO: 723 - RNA, 19 nt, Artificial Sequence
  Description of Artificial Sequence: Synthetic oligonucleotide
guuuuaaacaacugacaua

SEQ ID NO: 724 - RNA, 19 nt, Artificial Sequence
  Description of Artificial Sequence: Synthetic oligonucleotide
gguuuuaaacaacugacau

SEQ ID NO: 725 - RNA, 19 nt, Artificial Sequence
  Description of Artificial Sequence: Synthetic oligonucleotide
ggguuuuaaacaacugaca

SEQ ID NO: 726 - RNA, 19 nt, Artificial Sequence
  Description of Artificial Sequence: Synthetic oligonucleotide
uggguuuuaaacaacugac

SEQ ID NO: 727 - RNA, 19 nt, Artificial Sequence
  Description of Artificial Sequence: Synthetic oligonucleotide
uauuggguuuuaaacaacu

SEQ ID NO: 728 - RNA, 19 nt, Artificial Sequence
  Description of Artificial Sequence: Synthetic oligonucleotide
auauuggguuuuaaacaac

SEQ ID NO: 729 - RNA, 19 nt, Artificial Sequence
  Description of Artificial Sequence: Synthetic oligonucleotide
gauauuggguuuuaaacaa

SEQ ID NO: 730 - RNA, 19 nt, Artificial Sequence
  Description of Artificial Sequence: Synthetic oligonucleotide
agauauuggguuuuaaaca

SEQ ID NO: 731 - RNA, 19 nt, Artificial Sequence
  Description of Artificial Sequence: Synthetic oligonucleotide
uagauauuggguuuuaaac

SEQ ID NO: 732 - RNA, 19 nt, Artificial Sequence
  Description of Artificial Sequence: Synthetic oligonucleotide
uaaaaaauauacuucauca

SEQ ID NO: 733 - RNA, 19 nt, Artificial Sequence
  Description of Artificial Sequence: Synthetic oligonucleotide
auaaaaaauauacuucauc

SEQ ID NO: 734 - RNA, 19 nt, Artificial Sequence
  Description of Artificial Sequence: Synthetic oligonucleotide
aauaaaaaauauacuucau

SEQ ID NO: 735 - RNA, 19 nt, Artificial Sequence
  Description of Artificial Sequence: Synthetic oligonucleotide
gcaauaaaaaauauacuuc

SEQ ID NO: 736 - RNA, 19 nt, Artificial Sequence
  Description of Artificial Sequence: Synthetic oligonucleotide
uggcaauaaaaaauauacu

SEQ ID NO: 737 - RNA, 19 nt, Artificial Sequence
  Description of Artificial Sequence: Synthetic oligonucleotide
caaaggacaaaauggcaau

SEQ ID NO: 738 - RNA, 19 nt, Artificial Sequence
  Description of Artificial Sequence: Synthetic oligonucleotide
aucaaaggacaaaauggca

SEQ ID NO: 739 - RNA, 19 nt, Artificial Sequence
  Description of Artificial Sequence: Synthetic oligonucleotide
ucaaguuuagucaacuucc

SEQ ID NO: 740 - RNA, 19 nt, Artificial Sequence
  Description of Artificial Sequence: Synthetic oligonucleotide
uuucaaguuuagucaacuu

SEQ ID NO: 741 - RNA, 19 nt, Artificial Sequence
  Description of Artificial Sequence: Synthetic oligonucleotide
uuuuucaaguuuagucaac

SEQ ID NO: 742 - RNA, 19 nt, Artificial Sequence
  Description of Artificial Sequence: Synthetic oligonucleotide
auuuuucaaguuuagucaa

SEQ ID NO: 743 - RNA, 19 nt, Artificial Sequence
  Description of Artificial Sequence: Synthetic oligonucleotide
acauuuuucaaguuuaguc

SEQ ID NO: 744 - RNA, 19 nt, Artificial Sequence
  Description of Artificial Sequence: Synthetic oligonucleotide
aacauuuuucaaguuuagu

SEQ ID NO: 745 - RNA, 19 nt, Artificial Sequence
  Description of Artificial Sequence: Synthetic oligonucleotide
aaacauuuuucaaguuuag

SEQ ID NO: 746 - RNA, 19 nt, Artificial Sequence
  Description of Artificial Sequence: Synthetic oligonucleotide
uuuaaaaacauuuuucaag

SEQ ID NO: 747 - RNA, 19 nt, Artificial Sequence
  Description of Artificial Sequence: Synthetic oligonucleotide
uuuuaaaaacauuuuucaa

SEQ ID NO: 748 - RNA, 19 nt, Artificial Sequence
  Description of Artificial Sequence: Synthetic oligonucleotide
aguuuuaaaaacauuuuuc

SEQ ID NO: 749 - RNA, 19 nt, Artificial Sequence
  Description of Artificial Sequence: Synthetic oligonucleotide
caguuuuaaaaacauuuuu

SEQ ID NO: 750 - RNA, 19 nt, Artificial Sequence
  Description of Artificial Sequence: Synthetic oligonucleotide
acaguuuuaaaaacauuuu

SEQ ID NO: 751 - RNA, 19 nt, Artificial Sequence
  Description of Artificial Sequence: Synthetic oligonucleotide
cacaguuuuaaaaacauuu

SEQ ID NO: 752 - RNA, 19 nt, Artificial Sequence
  Description of Artificial Sequence: Synthetic oligonucleotide
ucacaguuuuaaaaacauu

SEQ ID NO: 753 - RNA, 19 nt, Artificial Sequence
  Description of Artificial Sequence: Synthetic oligonucleotide
uauucacaguuuuaaaaac

SEQ ID NO: 754 - RNA, 19 nt, Artificial Sequence
  Description of Artificial Sequence: Synthetic oligonucleotide
uuauucacaguuuuaaaaa

SEQ ID NO: 755 - RNA, 19 nt, Artificial Sequence
  Description of Artificial Sequence: Synthetic oligonucleotide
ccauuuauucacaguuuua

SEQ ID NO: 756 - RNA, 19 nt, Artificial Sequence
  Description of Artificial Sequence: Synthetic oligonucleotide
uccauuuauucacaguuuu

SEQ ID NO: 757 - RNA, 19 nt, Artificial Sequence
  Description of Artificial Sequence: Synthetic oligonucleotide
uuccauuuauucacaguuu

SEQ ID NO: 758 - RNA, 19 nt, Artificial Sequence
  Description of Artificial Sequence: Synthetic oligonucleotide
cuuccauuuauucacaguu

SEQ ID NO: 759 - RNA, 19 nt, Artificial Sequence
  Description of Artificial Sequence: Synthetic oligonucleotide
agcuuccauuuauucacag

SEQ ID NO: 760 - RNA, 19 nt, Artificial Sequence
  Description of Artificial Sequence: Synthetic oligonucleotide
uagcuuccauuuauucaca

SEQ ID NO: 761 - RNA, 19 nt, Artificial Sequence
  Description of Artificial Sequence: Synthetic oligonucleotide
guagcuuccauuuauucac

SEQ ID NO: 762 - RNA, 19 nt, Artificial Sequence
  Description of Artificial Sequence: Synthetic oligonucleotide
aguagcuuccauuuauuca

SEQ ID NO: 763 - RNA, 19 nt, Artificial Sequence
  Description of Artificial Sequence: Synthetic oligonucleotide
aaguagcuuccauuuauuc

SEQ ID NO: 764 - RNA, 19 nt, Artificial Sequence
  Description of Artificial Sequence: Synthetic oligonucleotide
aaaguagcuuccauuuauu

SEQ ID NO: 765 - RNA, 19 nt, Artificial Sequence
  Description of Artificial Sequence: Synthetic oligonucleotide
ucaaaguagcuuccauuua

SEQ ID NO: 766 - RNA, 19 nt, Artificial Sequence
  Description of Artificial Sequence: Synthetic oligonucleotide
gucaaaguagcuuccauuu

SEQ ID NO: 767 - RNA, 19 nt, Artificial Sequence
  Description of Artificial Sequence: Synthetic oligonucleotide
uagucaaaguagcuuccau

SEQ ID NO: 768 - RNA, 19 nt, Artificial Sequence
  Description of Artificial Sequence: Synthetic oligonucleotide
acuagucaaaguagcuucc

SEQ ID NO: 769 - RNA, 25 nt, Artificial Sequence
  Description of Artificial Sequence: Synthetic oligonucleotide
gcgcagcucuggaucuaccauguga

SEQ ID NO: 770 - RNA, 25 nt, Artificial Sequence
  Description of Artificial Sequence: Synthetic oligonucleotide
gcagcucuggaucuacccuaugaaa

SEQ ID NO: 771 - RNA, 25 nt, Artificial Sequence
  Description of Artificial Sequence: Synthetic oligonucleotide
cagcucuggaucuacccugagaaau

SEQ ID NO: 772 - RNA, 25 nt, Artificial Sequence
  Description of Artificial Sequence: Synthetic oligonucleotide
agcucuggaucuacccuguaaaauc

SEQ ID NO: 773 - RNA, 25 nt, Artificial Sequence
  Description of Artificial Sequence: Synthetic oligonucleotide
gcucuggaucuacccugugaaaucc

SEQ ID NO: 774 - RNA, 25 nt, Artificial Sequence
  Description of Artificial Sequence: Synthetic oligonucleotide
cucuggaucuacccugugaaauccu

SEQ ID NO: 775 - RNA, 25 nt, Artificial Sequence
  Description of Artificial Sequence: Synthetic oligonucleotide
ucuggaucuacccugugaaauccug

SEQ ID NO: 776 - RNA, 25 nt, Artificial Sequence
  Description of Artificial Sequence: Synthetic oligonucleotide
cuggaucuacccugugaaaaccugc

SEQ ID NO: 777 - RNA, 25 nt, Artificial Sequence
  Description of Artificial Sequence: Synthetic oligonucleotide
uggaucuacccugugaaauacugca

SEQ ID NO: 778 - RNA, 25 nt, Artificial Sequence
  Description of Artificial Sequence: Synthetic oligonucleotide
ggaucuacccugugaaaucaugcaa

SEQ ID NO: 779 - RNA, 25 nt, Artificial Sequence
  Description of Artificial Sequence: Synthetic oligonucleotide
gaucuacccugugaaauccagcaag

SEQ ID NO: 780 - RNA, 25 nt, Artificial Sequence
  Description of Artificial Sequence: Synthetic oligonucleotide
aucuacccugugaaauccuacaagg

SEQ ID NO: 781 - RNA, 25 nt, Artificial Sequence
  Description of Artificial Sequence: Synthetic oligonucleotide
ucuacccugugaaauccugaaaggg

SEQ ID NO: 782 - RNA, 25 nt, Artificial Sequence
  Description of Artificial Sequence: Synthetic oligonucleotide
cuacccugugaaauccugcaagggg

SEQ ID NO: 783 - RNA, 25 nt, Artificial Sequence
  Description of Artificial Sequence: Synthetic oligonucleotide
acccugugaaauccugcaaaggggu

SEQ ID NO: 784 - RNA, 25 nt, Artificial Sequence
  Description of Artificial Sequence: Synthetic oligonucleotide
cccugugaaauccugcaagagggug

SEQ ID NO: 785 - RNA, 25 nt, Artificial Sequence
  Description of Artificial Sequence: Synthetic oligonucleotide
ccugugaaauccugcaaggaggugc

SEQ ID NO: 786 - RNA, 25 nt, Artificial Sequence
  Description of Artificial Sequence: Synthetic oligonucleotide
ugaaauccugcaaggggguaccggu

SEQ ID NO: 787 - RNA, 25 nt, Artificial Sequence
  Description of Artificial Sequence: Synthetic oligonucleotide
aaauccugcaagggggugcagguga

SEQ ID NO: 788 - RNA, 25 nt, Artificial Sequence
  Description of Artificial Sequence: Synthetic oligonucleotide
aaccugcgggacagguuuuagcuug

SEQ ID NO: 789 - RNA, 25 nt, Artificial Sequence
  Description of Artificial Sequence: Synthetic oligonucleotide
accugcgggacagguuuugacuugu

SEQ ID NO: 790 - RNA, 25 nt, Artificial Sequence
  Description of Artificial Sequence: Synthetic oligonucleotide
ccugcgggacagguuuuggauugug

SEQ ID NO: 791 - RNA, 25 nt, Artificial Sequence
  Description of Artificial Sequence: Synthetic oligonucleotide
cugcgggacagguuuuggcauguga

SEQ ID NO: 792 - RNA, 25 nt, Artificial Sequence
  Description of Artificial Sequence: Synthetic oligonucleotide
gcgggacagguuuuggcuuaugauc

SEQ ID NO: 793 - RNA, 25 nt, Artificial Sequence
  Description of Artificial Sequence: Synthetic oligonucleotide
cgggacagguuuuggcuugagauca

SEQ ID NO: 794 - RNA, 25 nt, Artificial Sequence
  Description of Artificial Sequence: Synthetic oligonucleotide
gggacagguuuuggcuuguaaucaa

SEQ ID NO: 795 - RNA, 25 nt, Artificial Sequence
  Description of Artificial Sequence: Synthetic oligonucleotide
ggacagguuuuggcuugugaucaac

SEQ ID NO: 796 - RNA, 25 nt, Artificial Sequence
  Description of Artificial Sequence: Synthetic oligonucleotide
gacagguuuuggcuugugaacaacc

SEQ ID NO: 797 - RNA, 25 nt, Artificial Sequence
  Description of Artificial Sequence: Synthetic oligonucleotide
acagguuuuggcuugugauaaacca

SEQ ID NO: 798 - RNA, 25 nt, Artificial Sequence
  Description of Artificial Sequence: Synthetic oligonucleotide
cagguuuuggcuugugaucaaccag

SEQ ID NO: 799 - RNA, 25 nt, Artificial Sequence
  Description of Artificial Sequence: Synthetic oligonucleotide
agguuuuggcuugugaucaaccagg

SEQ ID NO: 800 - RNA, 25 nt, Artificial Sequence
  Description of Artificial Sequence: Synthetic oligonucleotide
gguuuuggcuugugaucaaacagga

SEQ ID NO: 801 - RNA, 25 nt, Artificial Sequence
  Description of Artificial Sequence: Synthetic oligonucleotide
guuuuggcuugugaucaacaaggag

SEQ ID NO: 802 - RNA, 25 nt, Artificial Sequence
  Description of Artificial Sequence: Synthetic oligonucleotide
uuuggcuugugaucaaccaagaggg

SEQ ID NO: 803 - RNA, 25 nt, Artificial Sequence
  Description of Artificial Sequence: Synthetic oligonucleotide
uuggcuugugaucaaccagaaggga

SEQ ID NO: 804 - RNA, 25 nt, Artificial Sequence
  Description of Artificial Sequence: Synthetic oligonucleotide
ggcuugugaucaaccaggaaggaaa

SEQ ID NO: 805 - RNA, 25 nt, Artificial Sequence
  Description of Artificial Sequence: Synthetic oligonucleotide
gcuugugaucaaccaggagagaaac

SEQ ID NO: 806 - RNA, 25 nt, Artificial Sequence
  Description of Artificial Sequence: Synthetic oligonucleotide
cuugugaucaaccaggaggaaaaca

SEQ ID NO: 807 - RNA, 25 nt, Artificial Sequence
  Description of Artificial Sequence: Synthetic oligonucleotide
uugugaucaaccaggagggaaacau

SEQ ID NO: 808 - RNA, 25 nt, Artificial Sequence
  Description of Artificial Sequence: Synthetic oligonucleotide
ugugaucaaccaggagggaaacaug

SEQ ID NO: 809 - RNA, 25 nt, Artificial Sequence
  Description of Artificial Sequence: Synthetic oligonucleotide
gugaucaaccaggagggaaacaugg

SEQ ID NO: 810 - RNA, 25 nt, Artificial Sequence
  Description of Artificial Sequence: Synthetic oligonucleotide
ugaucaaccaggagggaaaaauggu

SEQ ID NO: 811 - RNA, 25 nt, Artificial Sequence
  Description of Artificial Sequence: Synthetic oligonucleotide
aucaaccaggagggaaacaagguua

SEQ ID NO: 812 - RNA, 25 nt, Artificial Sequence
  Description of Artificial Sequence: Synthetic oligonucleotide
ucaaccaggagggaaacauaguuac

SEQ ID NO: 813 - RNA, 25 nt, Artificial Sequence
  Description of Artificial Sequence: Synthetic oligonucleotide
caaccaggagggaaacaugauuacu

SEQ ID NO: 814 - RNA, 25 nt, Artificial Sequence
  Description of Artificial Sequence: Synthetic oligonucleotide
aaccaggagggaaacauggauacug

SEQ ID NO: 815 - RNA, 25 nt, Artificial Sequence
  Description of Artificial Sequence: Synthetic oligonucleotide
accaggagggaaacaugguaacugc

SEQ ID NO: 816 - RNA, 25 nt, Artificial Sequence
  Description of Artificial Sequence: Synthetic oligonucleotide
ccaggagggaaacaugguuacugcu

SEQ ID NO: 817 - RNA, 25 nt, Artificial Sequence
  Description of Artificial Sequence: Synthetic oligonucleotide
caggagggaaacaugguuaaugcuc

SEQ ID NO: 818 - RNA, 25 nt, Artificial Sequence
  Description of Artificial Sequence: Synthetic oligonucleotide
aggagggaaacaugguuacagcucg

SEQ ID NO: 819 - RNA, 25 nt, Artificial Sequence
  Description of Artificial Sequence: Synthetic oligonucleotide
ggagggaaacaugguuacuacucgc

SEQ ID NO: 820 - RNA, 25 nt, Artificial Sequence
  Description of Artificial Sequence: Synthetic oligonucleotide
gagggaaacaugguuacugaucgcc

SEQ ID NO: 821 - RNA, 25 nt, Artificial Sequence
  Description of Artificial Sequence: Synthetic oligonucleotide
gggaaacaugguuacugcuagccag

SEQ ID NO: 822 - RNA, 25 nt, Artificial Sequence
  Description of Artificial Sequence: Synthetic oligonucleotide
ggaaacaugguuacugcucaccagg

SEQ ID NO: 823 - RNA, 25 nt, Artificial Sequence
  Description of Artificial Sequence: Synthetic oligonucleotide
gaaacaugguuacugcucgacagga

SEQ ID NO: 824 - RNA, 25 nt, Artificial Sequence
  Description of Artificial Sequence: Synthetic oligonucleotide
aaacaugguuacugcucgcaaggaa

SEQ ID NO: 825 - RNA, 25 nt, Artificial Sequence
  Description of Artificial Sequence: Synthetic oligonucleotide
aacaugguuacugcucgccaggaac

SEQ ID NO: 826 - RNA, 25 nt, Artificial Sequence
  Description of Artificial Sequence: Synthetic oligonucleotide
acaugguuacugcucgccaagaacc

SEQ ID NO: 827 - RNA, 25 nt, Artificial Sequence
  Description of Artificial Sequence: Synthetic oligonucleotide
caugguuacugcucgccagaaaccu

SEQ ID NO: 828 - RNA, 25 nt, Artificial Sequence
  Description of Artificial Sequence: Synthetic oligonucleotide
gguuacugcucgccaggaaacucgc

SEQ ID NO: 829 - RNA, 25 nt, Artificial Sequence
  Description of Artificial Sequence: Synthetic oligonucleotide
gccaggaaccucgccugguacugau

SEQ ID NO: 830 - RNA, 25 nt, Artificial Sequence
  Description of Artificial Sequence: Synthetic oligonucleotide
aggaaccucgccugguccuaauuuc

SEQ ID NO: 831 - RNA, 25 nt, Artificial Sequence
  Description of Artificial Sequence: Synthetic oligonucleotide
ccucgccugguccugauuuaccuga

SEQ ID NO: 832 - RNA, 25 nt, Artificial Sequence
  Description of Artificial Sequence: Synthetic oligonucleotide
cucgccugguccugauuucacugac

SEQ ID NO: 833 - RNA, 25 nt, Artificial Sequence
  Description of Artificial Sequence: Synthetic oligonucleotide
gccugguccugauuucccuaaccug

SEQ ID NO: 834 - RNA, 25 nt, Artificial Sequence
  Description of Artificial Sequence: Synthetic oligonucleotide
cugguccugauuucccugaacugcg

SEQ ID NO: 835 - RNA, 25 nt, Artificial Sequence
  Description of Artificial Sequence: Synthetic oligonucleotide
ugguccugauuucccugacaugcga

SEQ ID NO: 836 - RNA, 25 nt, Artificial Sequence
  Description of Artificial Sequence: Synthetic oligonucleotide
guccugauuucccugaccuacgaug

SEQ ID NO: 837 - RNA, 25 nt, Artificial Sequence
  Description of Artificial Sequence: Synthetic oligonucleotide
ccugauuucccugaccugcaauggu

SEQ ID NO: 838 - RNA, 25 nt, Artificial Sequence
  Description of Artificial Sequence: Synthetic oligonucleotide
cugaccugcgauggugacaaccuga

SEQ ID NO: 839 - RNA, 25 nt, Artificial Sequence
  Description of Artificial Sequence: Synthetic oligonucleotide
ccugcgauggugacacccuaacucu

SEQ ID NO: 840 - RNA, 25 nt, Artificial Sequence
  Description of Artificial Sequence: Synthetic oligonucleotide
ugcgauggugacacccugaaucuca

SEQ ID NO: 841 - RNA, 25 nt, Artificial Sequence
  Description of Artificial Sequence: Synthetic oligonucleotide
gcgauggugacacccugacacucag

SEQ ID NO: 842 - RNA, 25 nt, Artificial Sequence
  Description of Artificial Sequence: Synthetic oligonucleotide
cgauggugacacccugacuaucagu

SEQ ID NO: 843 - RNA, 25 nt, Artificial Sequence
  Description of Artificial Sequence: Synthetic oligonucleotide
gauggugacacccugacucacagug

SEQ ID NO: 844 - RNA, 25 nt, Artificial Sequence
  Description of Artificial Sequence: Synthetic oligonucleotide
auggugacacccugacucuaagugc

SEQ ID NO: 845 - RNA, 25 nt, Artificial Sequence
  Description of Artificial Sequence: Synthetic oligonucleotide
uggugacacccugacucucagugca

SEQ ID NO: 846 - RNA, 25 nt, Artificial Sequence
  Description of Artificial Sequence: Synthetic oligonucleotide
ggugacacccugacucucaaugcag

SEQ ID NO: 847 - RNA, 25 nt, Artificial Sequence
  Description of Artificial Sequence: Synthetic oligonucleotide
gugacacccugacucucagagcagc

SEQ ID NO: 848 - RNA, 25 nt, Artificial Sequence
  Description of Artificial Sequence: Synthetic oligonucleotide
ugacacccugacucucaguacagcc

SEQ ID NO: 849 - RNA, 25 nt, Artificial Sequence
  Description of Artificial Sequence: Synthetic oligonucleotide
gacacccugacucucagugaagccu

SEQ ID NO: 850 - RNA, 25 nt, Artificial Sequence
  Description of Artificial Sequence: Synthetic oligonucleotide
acacccugacucucagugcagccua

SEQ ID NO: 851 - RNA, 25 nt, Artificial Sequence
  Description of Artificial Sequence: Synthetic oligonucleotide
cacccugacucucagugcaaccuac

SEQ ID NO: 852 - RNA, 25 nt, Artificial Sequence
  Description of Artificial Sequence: Synthetic oligonucleotide
acccugacucucagugcagacuaca

SEQ ID NO: 853 - RNA, 25 nt, Artificial Sequence
  Description of Artificial Sequence: Synthetic oligonucleotide
cccugacucucagugcagcauacac

SEQ ID NO: 854 - RNA, 25 nt, Artificial Sequence
  Description of Artificial Sequence: Synthetic oligonucleotide
ccugacucucagugcagccaacaca

SEQ ID NO: 855 - RNA, 25 nt, Artificial Sequence
  Description of Artificial Sequence: Synthetic oligonucleotide
cugacucucagugcagccuacacaa

SEQ ID NO: 856 - RNA, 25 nt, Artificial Sequence
  Description of Artificial Sequence: Synthetic oligonucleotide
ugacucucagugcagccuaaacaaa

SEQ ID NO: 857 - RNA, 25 nt, Artificial Sequence
  Description of Artificial Sequence: Synthetic oligonucleotide
gacucucagugcagccuacacaaag

SEQ ID NO: 858 - RNA, 25 nt, Artificial Sequence
  Description of Artificial Sequence: Synthetic oligonucleotide
acucucagugcagccuacaaaaagg

SEQ ID NO: 859 - RNA, 25 nt, Artificial Sequence
  Description of Artificial Sequence: Synthetic oligonucleotide
cucucagugcagccuacacaaagga

SEQ ID NO: 860 - RNA, 25 nt, Artificial Sequence
  Description of Artificial Sequence: Synthetic oligonucleotide
ucucagugcagccuacacaaaggac

SEQ ID NO: 861 - RNA, 25 nt, Artificial Sequence
  Description of Artificial Sequence: Synthetic oligonucleotide
ucagugcagccuacacaaaagaccu

SEQ ID NO: 862 - RNA, 25 nt, Artificial Sequence
  Description of Artificial Sequence: Synthetic oligonucleotide
cagugcagccuacacaaagaaccua

SEQ ID NO: 863 - RNA, 25 nt, Artificial Sequence
  Description of Artificial Sequence: Synthetic oligonucleotide
agugcagccuacacaaaggaccuac

SEQ ID NO: 864 - RNA, 25 nt, Artificial Sequence
  Description of Artificial Sequence: Synthetic oligonucleotide
gugcagccuacacaaaggaacuacu

SEQ ID NO: 865 - RNA, 25 nt, Artificial Sequence
  Description of Artificial Sequence: Synthetic oligonucleotide
ugcagccuacacaaaggacauacua

SEQ ID NO: 866 - RNA, 25 nt, Artificial Sequence
  Description of Artificial Sequence: Synthetic oligonucleotide
gcagccuacacaaaggaccaacuac

SEQ ID NO: 867 - RNA, 25 nt, Artificial Sequence
  Description of Artificial Sequence: Synthetic oligonucleotide
cagccuacacaaaggaccuacuacu

SEQ ID NO: 868 - RNA, 25 nt, Artificial Sequence
  Description of Artificial Sequence: Synthetic oligonucleotide
agccuacacaaaggaccuaauacug

SEQ ID NO: 869 - RNA, 25 nt, Artificial Sequence
  Description of Artificial Sequence: Synthetic oligonucleotide
gccuacacaaaggaccuacaacugc

SEQ ID NO: 870 - RNA, 25 nt, Artificial Sequence
  Description of Artificial Sequence: Synthetic oligonucleotide
acacaaaggaccuacuacuaccuau

SEQ ID NO: 871 - RNA, 25 nt, Artificial Sequence
  Description of Artificial Sequence: Synthetic oligonucleotide
cacaaaggaccuacuacugacuauc

SEQ ID NO: 872 - RNA, 25 nt, Artificial Sequence
  Description of Artificial Sequence: Synthetic oligonucleotide
acaaaggaccuacuacugcauauca

SEQ ID NO: 873 - RNA, 25 nt, Artificial Sequence
  Description of Artificial Sequence: Synthetic oligonucleotide
caaaggaccuacuacugccaaucaa

SEQ ID NO: 874 - RNA, 25 nt, Artificial Sequence
  Description of Artificial Sequence: Synthetic oligonucleotide
aaaggaccuacuacugccuaucaaa

SEQ ID NO: 875 - RNA, 25 nt, Artificial Sequence
  Description of Artificial Sequence: Synthetic oligonucleotide
aaggaccuacuacugccuaacaaaa

SEQ ID NO: 876 - RNA, 25 nt, Artificial Sequence
  Description of Artificial Sequence: Synthetic oligonucleotide
aggaccuacuacugccuauaaaaac

SEQ ID NO: 877 - RNA, 25 nt, Artificial Sequence
  Description of Artificial Sequence: Synthetic oligonucleotide
ggaccuacuacugccuaucaaaacg

SEQ ID NO: 878 - RNA, 25 nt, Artificial Sequence
  Description of Artificial Sequence: Synthetic oligonucleotide
gaccuacuacugccuaucaaaacgc

SEQ ID NO: 879 - RNA, 25 nt, Artificial Sequence
  Description of Artificial Sequence: Synthetic oligonucleotide
accuacuacugccuaucaaaacgcc

SEQ ID NO: 880 - RNA, 25 nt, Artificial Sequence
  Description of Artificial Sequence: Synthetic oligonucleotide
cuacuacugccuaucaaaaagccca

SEQ ID NO: 881 - RNA, 25 nt, Artificial Sequence
  Description of Artificial Sequence: Synthetic oligonucleotide
uacuacugccuaucaaaacacccac

SEQ ID NO: 882 - RNA, 25 nt, Artificial Sequence
  Description of Artificial Sequence: Synthetic oligonucleotide
acuacugccuaucaaaacgaccacc

SEQ ID NO: 883 - RNA, 25 nt, Artificial Sequence
  Description of Artificial Sequence: Synthetic oligonucleotide
cuacugccuaucaaaacgcacacca

SEQ ID NO: 884 - RNA, 25 nt, Artificial Sequence
  Description of Artificial Sequence: Synthetic oligonucleotide
uacugccuaucaaaacgccaaccac

SEQ ID NO: 885 - RNA, 25 nt, Artificial Sequence
  Description of Artificial Sequence: Synthetic oligonucleotide
cugccuaucaaaacgcccaacacaa

SEQ ID NO: 886 - RNA, 25 nt, Artificial Sequence
  Description of Artificial Sequence: Synthetic oligonucleotide
aucaaaacgcccaccacaaaugcag

SEQ ID NO: 887 - RNA, 25 nt, Artificial Sequence
  Description of Artificial Sequence: Synthetic oligonucleotide
ucaaaacgcccaccacaaaagcagu

SEQ ID NO: 888 - RNA, 25 nt, Artificial Sequence
  Description of Artificial Sequence: Synthetic oligonucleotide
caaaacgcccaccacaaauacagug

SEQ ID NO: 889 - RNA, 25 nt, Artificial Sequence
  Description of Artificial Sequence: Synthetic oligonucleotide
aaaacgcccaccacaaaugaagugc

SEQ ID NO: 890 - RNA, 25 nt, Artificial Sequence
  Description of Artificial Sequence: Synthetic oligonucleotide
aacgcccaccacaaaugcaaugcac

SEQ ID NO: 891 - RNA, 25 nt, Artificial Sequence
  Description of Artificial Sequence: Synthetic oligonucleotide
cgcccaccacaaaugcaguacacaa

SEQ ID NO: 892 - RNA, 25 nt, Artificial Sequence
  Description of Artificial Sequence: Synthetic oligonucleotide
gcccaccacaaaugcagugaacaag

SEQ ID NO: 893 - RNA, 25 nt, Artificial Sequence
  Description of Artificial Sequence: Synthetic oligonucleotide
cacaaaugcagugcacaagagcaga

SEQ ID NO: 894 - RNA, 25 nt, Artificial Sequence
  Description of Artificial Sequence: Synthetic oligonucleotide
acaaaugcagugcacaaguacagag

SEQ ID NO: 895 - RNA, 25 nt, Artificial Sequence
  Description of Artificial Sequence: Synthetic oligonucleotide
caaaugcagugcacaagugaagagu

SEQ ID NO: 896 - RNA, 25 nt, Artificial Sequence
  Description of Artificial Sequence: Synthetic oligonucleotide
gcccaguggauaaccagcuaccuga

SEQ ID NO: 897 - RNA, 25 nt, Artificial Sequence
  Description of Artificial Sequence: Synthetic oligonucleotide
cccaguggauaaccagcuuacugaa

SEQ ID NO: 898 - RNA, 25 nt, Artificial Sequence
  Description of Artificial Sequence: Synthetic oligonucleotide
ccaguggauaaccagcuucaugaag

SEQ ID NO: 899 - RNA, 25 nt, Artificial Sequence
  Description of Artificial Sequence: Synthetic oligonucleotide
caguggauaaccagcuuccagaagu

SEQ ID NO: 900 - RNA, 25 nt, Artificial Sequence
  Description of Artificial Sequence: Synthetic oligonucleotide
aguggauaaccagcuuccuaaaguc

SEQ ID NO: 901 - RNA, 25 nt, Artificial Sequence
  Description of Artificial Sequence: Synthetic oligonucleotide
guggauaaccagcuuccugaaguca

SEQ ID NO: 902 - RNA, 25 nt, Artificial Sequence
  Description of Artificial Sequence: Synthetic oligonucleotide
uggauaaccagcuuccugaagucac

SEQ ID NO: 903 - RNA, 25 nt, Artificial Sequence
  Description of Artificial Sequence: Synthetic oligonucleotide
ggauaaccagcuuccugaaaucaca

SEQ ID NO: 904 - RNA, 25 nt, Artificial Sequence
  Description of Artificial Sequence: Synthetic oligonucleotide
gauaaccagcuuccugaagacacag

SEQ ID NO: 905 - RNA, 25 nt, Artificial Sequence
  Description of Artificial Sequence: Synthetic oligonucleotide
auaaccagcuuccugaaguaacagc

SEQ ID NO: 906 - RNA, 25 nt, Artificial Sequence
  Description of Artificial Sequence: Synthetic oligonucleotide
uaaccagcuuccugaagucacagcc

SEQ ID NO: 907 - RNA, 25 nt, Artificial Sequence
  Description of Artificial Sequence: Synthetic oligonucleotide
aaccagcuuccugaagucaaagccc

SEQ ID NO: 908 - RNA, 25 nt, Artificial Sequence
  Description of Artificial Sequence: Synthetic oligonucleotide
accagcuuccugaagucacagcccu

SEQ ID NO: 909 - RNA, 25 nt, Artificial Sequence
  Description of Artificial Sequence: Synthetic oligonucleotide
ccagcuuccugaagucacaacccua

SEQ ID NO: 910 - RNA, 25 nt, Artificial Sequence
  Description of Artificial Sequence: Synthetic oligonucleotide
cagcuuccugaagucacagaccuac

SEQ ID NO: 911 - RNA, 25 nt, Artificial Sequence
  Description of Artificial Sequence: Synthetic oligonucleotide
agcuuccugaagucacagcacuacc

SEQ ID NO: 912 - RNA, 25 nt, Artificial Sequence
  Description of Artificial Sequence: Synthetic oligonucleotide
gcuuccugaagucacagccauaccg

SEQ ID NO: 913 - RNA, 25 nt, Artificial Sequence
  Description of Artificial Sequence: Synthetic oligonucleotide
accgccuggugcacuucgaaccuca

SEQ ID NO: 914 - RNA, 25 nt, Artificial Sequence
  Description of Artificial Sequence: Synthetic oligonucleotide
cgccuggugcacuucgagcaucaca

SEQ ID NO: 915 - RNA, 25 nt, Artificial Sequence
  Description of Artificial Sequence: Synthetic oligonucleotide
gccuggugcacuucgagccacacau

SEQ ID NO: 916 - RNA, 25 nt, Artificial Sequence
  Description of Artificial Sequence: Synthetic oligonucleotide
ccuggugcacuucgagccuaacaug

SEQ ID NO: 917 - RNA, 25 nt, Artificial Sequence
  Description of Artificial Sequence: Synthetic oligonucleotide
gugcacuucgagccucacaagcgac

SEQ ID NO: 918 - RNA, 25 nt, Artificial Sequence
  Description of Artificial Sequence: Synthetic oligonucleotide
cacuucgagccucacaugcaaccga

SEQ ID NO: 919 - RNA, 25 nt, Artificial Sequence
  Description of Artificial Sequence: Synthetic oligonucleotide
cacaugcgaccgagacgucaucauc

SEQ ID NO: 920 - RNA, 25 nt, Artificial Sequence
  Description of Artificial Sequence: Synthetic oligonucleotide
caugcgaccgagacguccuaaucaa

SEQ ID NO: 921 - RNA, 25 nt, Artificial Sequence
  Description of Artificial Sequence: Synthetic oligonucleotide
gcgaccgagacguccucauaaaaua

SEQ ID NO: 922 - RNA, 25 nt, Artificial Sequence
  Description of Artificial Sequence: Synthetic oligonucleotide
cgaccgagacguccucaucaaauag

SEQ ID NO: 923 - RNA, 25 nt, Artificial Sequence
  Description of Artificial Sequence: Synthetic oligonucleotide
accgagacguccucaucaaauagca

SEQ ID NO: 924 - RNA, 25 nt, Artificial Sequence
  Description of Artificial Sequence: Synthetic oligonucleotide
ccgagacguccucaucaaaaagcag

SEQ ID NO: 925 - RNA, 25 nt, Artificial Sequence
  Description of Artificial Sequence: Synthetic oligonucleotide
cgagacguccucaucaaauagcaga

SEQ ID NO: 926 - RNA, 25 nt, Artificial Sequence
  Description of Artificial Sequence: Synthetic oligonucleotide
gagacguccucaucaaauaacagac

SEQ ID NO: 927 - RNA, 25 nt, Artificial Sequence
  Description of Artificial Sequence: Synthetic oligonucleotide
agacguccucaucaaauagaagacu

SEQ ID NO: 928 - RNA, 25 nt, Artificial Sequence
  Description of Artificial Sequence: Synthetic oligonucleotide
gacguccucaucaaauagcagacuu

SEQ ID NO: 929 - RNA, 25 nt, Artificial Sequence
  Description of Artificial Sequence: Synthetic oligonucleotide
acguccucaucaaauagcaaacuug

SEQ ID NO: 930 - RNA, 25 nt, Artificial Sequence
  Description of Artificial Sequence: Synthetic oligonucleotide
cguccucaucaaauagcagacuugu

SEQ ID NO: 931 - RNA, 25 nt, Artificial Sequence
  Description of Artificial Sequence: Synthetic oligonucleotide
guccucaucaaauagcagaauuguu

SEQ ID NO: 932 - RNA, 25 nt, Artificial Sequence
  Description of Artificial Sequence: Synthetic oligonucleotide
uccucaucaaauagcagacauguuc

SEQ ID NO: 933 - RNA, 25 nt, Artificial Sequence
  Description of Artificial Sequence: Synthetic oligonucleotide
ccucaucaaauagcagacuaguucc

SEQ ID NO: 934 - RNA, 25 nt, Artificial Sequence
  Description of Artificial Sequence: Synthetic oligonucleotide
cucaucaaauagcagacuuauuccg

SEQ ID NO: 935 - RNA, 25 nt, Artificial Sequence
  Description of Artificial Sequence: Synthetic oligonucleotide
ucaucaaauagcagacuugauccga

SEQ ID NO: 936 - RNA, 25 nt, Artificial Sequence
  Description of Artificial Sequence: Synthetic oligonucleotide
caucaaauagcagacuuguaccgac

SEQ ID NO: 937 - RNA, 25 nt, Artificial Sequence
  Description of Artificial Sequence: Synthetic oligonucleotide
aucaaauagcagacuuguuacgacc

SEQ ID NO: 938 - RNA, 25 nt, Artificial Sequence
  Description of Artificial Sequence: Synthetic oligonucleotide
ucaaauagcagacuuguucagaccc

SEQ ID NO: 939 - RNA, 25 nt, Artificial Sequence
  Description of Artificial Sequence: Synthetic oligonucleotide
caaauagcagacuuguuccaaccca

SEQ ID NO: 940 - RNA, 25 nt, Artificial Sequence
  Description of Artificial Sequence: Synthetic oligonucleotide
aaauagcagacuuguuccgacccaa

SEQ ID NO: 941 - RNA, 25 nt, Artificial Sequence
  Description of Artificial Sequence: Synthetic oligonucleotide
aauagcagacuuguuccgaaccaag

SEQ ID NO: 942 - RNA, 25 nt, Artificial Sequence
  Description of Artificial Sequence: Synthetic oligonucleotide
auagcagacuuguuccgacacaagg

SEQ ID NO: 943 - RNA, 25 nt, Artificial Sequence
  Description of Artificial Sequence: Synthetic oligonucleotide
uagcagacuuguuccgaccaaagga

SEQ ID NO: 944 - RNA, 25 nt, Artificial Sequence
  Description of Artificial Sequence: Synthetic oligonucleotide
agcagacuuguuccgacccaaggac

SEQ ID NO: 945 - RNA, 25 nt, Artificial Sequence
  Description of Artificial Sequence: Synthetic oligonucleotide
gcagacuuguuccgacccaaggacc

SEQ ID NO: 946 - RNA, 25 nt, Artificial Sequence
  Description of Artificial Sequence: Synthetic oligonucleotide
cagacuuguuccgacccaaagacca

SEQ ID NO: 947 - RNA, 25 nt, Artificial Sequence
  Description of Artificial Sequence: Synthetic oligonucleotide
agacuuguuccgacccaagaaccag

SEQ ID NO: 948 - RNA, 25 nt, Artificial Sequence
  Description of Artificial Sequence: Synthetic oligonucleotide
gacuuguuccgacccaaggaccaga

SEQ ID NO: 949 - RNA, 25 nt, Artificial Sequence
  Description of Artificial Sequence: Synthetic oligonucleotide
acuuguuccgacccaaggaacagau

SEQ ID NO: 950 - RNA, 25 nt, Artificial Sequence
  Description of Artificial Sequence: Synthetic oligonucleotide
cuuguuccgacccaaggacaagauu

SEQ ID NO: 951 - RNA, 25 nt, Artificial Sequence
  Description of Artificial Sequence: Synthetic oligonucleotide
uuguuccgacccaaggaccagauug

SEQ ID NO: 952 - RNA, 25 nt, Artificial Sequence
  Description of Artificial Sequence: Synthetic oligonucleotide
uguuccgacccaaggaccaaauugc

SEQ ID NO: 953 - RNA, 25 nt, Artificial Sequence
  Description of Artificial Sequence: Synthetic oligonucleotide
guuccgacccaaggaccagauugcu

SEQ ID NO: 954 - RNA, 25 nt, Artificial Sequence
  Description of Artificial Sequence: Synthetic oligonucleotide
uuccgacccaaggaccagaaugcuu

SEQ ID NO: 955 - RNA, 25 nt, Artificial Sequence
  Description of Artificial Sequence: Synthetic oligonucleotide
uccgacccaaggaccagauagcuua

SEQ ID NO: 956 - RNA, 25 nt, Artificial Sequence
  Description of Artificial Sequence: Synthetic oligonucleotide
ccgacccaaggaccagauuacuuac

SEQ ID NO: 957 - RNA, 25 nt, Artificial Sequence
  Description of Artificial Sequence: Synthetic oligonucleotide
cgacccaaggaccagauugauuacu

SEQ ID NO: 958 - RNA, 25 nt, Artificial Sequence
  Description of Artificial Sequence: Synthetic oligonucleotide
gacccaaggaccagauugcauacuc

SEQ ID NO: 959 - RNA, 25 nt, Artificial Sequence
  Description of Artificial Sequence: Synthetic oligonucleotide
acccaaggaccagauugcuaacuca

SEQ ID NO: 960 - RNA, 25 nt, Artificial Sequence
  Description of Artificial Sequence: Synthetic oligonucleotide
cccaaggaccagauugcuuacucag

SEQ ID NO: 961 - RNA, 25 nt, Artificial Sequence
  Description of Artificial Sequence: Synthetic oligonucleotide
ccaaggaccagauugcuuaaucaga

SEQ ID NO: 962 - RNA, 25 nt, Artificial Sequence
  Description of Artificial Sequence: Synthetic oligonucleotide
caaggaccagauugcuuacacagac

SEQ ID NO: 963 - RNA, 25 nt, Artificial Sequence
  Description of Artificial Sequence: Synthetic oligonucleotide
aaggaccagauugcuuacuaagaca

SEQ ID NO: 964 - RNA, 25 nt, Artificial Sequence
  Description of Artificial Sequence: Synthetic oligonucleotide
aggaccagauugcuuacucagacac

SEQ ID NO: 965 - RNA, 25 nt, Artificial Sequence
  Description of Artificial Sequence: Synthetic oligonucleotide
ggaccagauugcuuacucaaacacc

SEQ ID NO: 966 - RNA, 25 nt, Artificial Sequence
  Description of Artificial Sequence: Synthetic oligonucleotide
gaccagauugcuuacucagacacca

SEQ ID NO: 967 - RNA, 25 nt, Artificial Sequence
  Description of Artificial Sequence: Synthetic oligonucleotide
accagauugcuuacucagaaaccag

SEQ ID NO: 968 - RNA, 25 nt, Artificial Sequence
  Description of Artificial Sequence: Synthetic oligonucleotide
ccagauugcuuacucagacaccagc

SEQ ID NO: 969 - RNA, 25 nt, Artificial Sequence
  Description of Artificial Sequence: Synthetic oligonucleotide
cagauugcuuacucagacaacagcc

SEQ ID NO: 970 - RNA, 25 nt, Artificial Sequence
  Description of Artificial Sequence: Synthetic oligonucleotide
agauugcuuacucagacacaagccc

SEQ ID NO: 971 - RNA, 25 nt, Artificial Sequence
  Description of Artificial Sequence: Synthetic oligonucleotide
gauugcuuacucagacaccagccca

SEQ ID NO: 972 - RNA, 25 nt, Artificial Sequence
  Description of Artificial Sequence: Synthetic oligonucleotide
auugcuuacucagacaccaacccau

SEQ ID NO: 973 - RNA, 25 nt, Artificial Sequence
  Description of Artificial Sequence: Synthetic oligonucleotide
uugcuuacucagacaccagaccauu

SEQ ID NO: 974 - RNA, 25 nt, Artificial Sequence
  Description of Artificial Sequence: Synthetic oligonucleotide
ugcuuacucagacaccagcacauuc

SEQ ID NO: 975 - RNA, 25 nt, Artificial Sequence
  Description of Artificial Sequence: Synthetic oligonucleotide
gcuuacucagacaccagccaauucu

SEQ ID NO: 976 - RNA, 25 nt, Artificial Sequence
  Description of Artificial Sequence: Synthetic oligonucleotide
cuuacucagacaccagcccauucuu

SEQ ID NO: 977 - RNA, 25 nt, Artificial Sequence
  Description of Artificial Sequence: Synthetic oligonucleotide
uuacucagacaccagcccaaucuug

SEQ ID NO: 978 - RNA, 25 nt, Artificial Sequence
  Description of Artificial Sequence: Synthetic oligonucleotide
uacucagacaccagcccauacuuga

SEQ ID NO: 979 - RNA, 25 nt, Artificial Sequence
  Description of Artificial Sequence: Synthetic oligonucleotide
acucagacaccagcccauuauugau

SEQ ID NO: 980 - RNA, 25 nt, Artificial Sequence
  Description of Artificial Sequence: Synthetic oligonucleotide
cucagacaccagcccauucaugauc

SEQ ID NO: 981 - RNA, 25 nt, Artificial Sequence
  Description of Artificial Sequence: Synthetic oligonucleotide
ucagacaccagcccauucuagaucc

SEQ ID NO: 982 - RNA, 25 nt, Artificial Sequence
  Description of Artificial Sequence: Synthetic oligonucleotide
cagacaccagcccauucuuaauccu

SEQ ID NO: 983 - RNA, 25 nt, Artificial Sequence
  Description of Artificial Sequence: Synthetic oligonucleotide
agacaccagcccauucuugauccuu

SEQ ID NO: 984 - RNA, 25 nt, Artificial Sequence
  Description of Artificial Sequence: Synthetic oligonucleotide
gacaccagcccauucuugaaccuuu

SEQ ID NO: 985 - RNA, 25 nt, Artificial Sequence
  Description of Artificial Sequence: Synthetic oligonucleotide
acaccagcccauucuugauacuuuc

SEQ ID NO: 986 - RNA, 25 nt, Artificial Sequence
  Description of Artificial Sequence: Synthetic oligonucleotide
caccagcccauucuugaucauuucu

SEQ ID NO: 987 - RNA, 25 nt, Artificial Sequence
  Description of Artificial Sequence: Synthetic oligonucleotide
accagcccauucuugauccauucug

SEQ ID NO: 988 - RNA, 25 nt, Artificial Sequence
  Description of Artificial Sequence: Synthetic oligonucleotide
ccagcccauucuugauccuaucuga

SEQ ID NO: 989 - RNA, 25 nt, Artificial Sequence
  Description of Artificial Sequence: Synthetic oligonucleotide
cagcccauucuugauccuuacugag

SEQ ID NO: 990 - RNA, 25 nt, Artificial Sequence
  Description of Artificial Sequence: Synthetic oligonucleotide
agcccauucuugauccuuuaugagg

SEQ ID NO: 991 - RNA, 25 nt, Artificial Sequence
  Description of Artificial Sequence: Synthetic oligonucleotide
cauucuugauccuuucugaagcguc

SEQ ID NO: 992 - RNA, 25 nt, Artificial Sequence
  Description of Artificial Sequence: Synthetic oligonucleotide
auucuugauccuuucugagacgucg

SEQ ID NO: 993 - RNA, 25 nt, Artificial Sequence
  Description of Artificial Sequence: Synthetic oligonucleotide
aucucaacuccaggcuagaaaagaa

SEQ ID NO: 994 - RNA, 25 nt, Artificial Sequence
  Description of Artificial Sequence: Synthetic oligonucleotide
cucaacuccaggcuagagaagaaag

SEQ ID NO: 995 - RNA, 25 nt, Artificial Sequence
  Description of Artificial Sequence: Synthetic oligonucleotide
caacuccaggcuagagaagaaaguu

SEQ ID NO: 996 - RNA, 25 nt, Artificial Sequence
  Description of Artificial Sequence: Synthetic oligonucleotide
aacuccaggcuagagaagaaaguua

SEQ ID NO: 997 - RNA, 25 nt, Artificial Sequence
  Description of Artificial Sequence: Synthetic oligonucleotide
acuccaggcuagagaagaaaguuaa

SEQ ID NO: 998 - RNA, 25 nt, Artificial Sequence
  Description of Artificial Sequence: Synthetic oligonucleotide
cuccaggcuagagaagaaaauuaaa

SEQ ID NO: 999 - RNA, 25 nt, Artificial Sequence
  Description of Artificial Sequence: Synthetic oligonucleotide
ccaggcuagagaagaaaguaaaagc

SEQ ID NO: 1000 - RNA, 25 nt, Artificial Sequence
  Description of Artificial Sequence: Synthetic oligonucleotide
caggcuagagaagaaaguuaaagca

SEQ ID NO: 1001 - RNA, 25 nt, Artificial Sequence
  Description of Artificial Sequence: Synthetic oligonucleotide
aggcuagagaagaaaguuaaagcaa

SEQ ID NO: 1002 - RNA, 25 nt, Artificial Sequence
  Description of Artificial Sequence: Synthetic oligonucleotide
ggcuagagaagaaaguuaaagcaac

SEQ ID NO: 1003 - RNA, 25 nt, Artificial Sequence
  Description of Artificial Sequence: Synthetic oligonucleotide
gcuagagaagaaaguuaaaacaacc

SEQ ID NO: 1004 - RNA, 25 nt, Artificial Sequence
  Description of Artificial Sequence: Synthetic oligonucleotide
cuagagaagaaaguuaaagaaacca

SEQ ID NO: 1005 - RNA, 25 nt, Artificial Sequence
  Description of Artificial Sequence: Synthetic oligonucleotide
uagagaagaaaguuaaagcaaccaa

SEQ ID NO: 1006 - RNA, 25 nt, Artificial Sequence
  Description of Artificial Sequence: Synthetic oligonucleotide
agagaagaaaguuaaagcaaccaac

SEQ ID NO: 1007 - RNA, 25 nt, Artificial Sequence
  Description of Artificial Sequence: Synthetic oligonucleotide
gagaagaaaguuaaagcaaacaacu

SEQ ID NO: 1008 - RNA, 25 nt, Artificial Sequence
  Description of Artificial Sequence: Synthetic oligonucleotide
agaagaaaguuaaagcaacaaacuu

SEQ ID NO: 1009 - RNA, 25 nt, Artificial Sequence
  Description of Artificial Sequence: Synthetic oligonucleotide
gaagaaaguuaaagcaaccaacuuc

SEQ ID NO: 1010 - RNA, 25 nt, Artificial Sequence
  Description of Artificial Sequence: Synthetic oligonucleotide
aagaaaguuaaagcaaccaacuuca

SEQ ID NO: 1011 - RNA, 25 nt, Artificial Sequence
  Description of Artificial Sequence: Synthetic oligonucleotide
agaaaguuaaagcaaccaaauucag

SEQ ID NO: 1012 - RNA, 25 nt, Artificial Sequence
  Description of Artificial Sequence: Synthetic oligonucleotide
gaaaguuaaagcaaccaacaucagg

SEQ ID NO: 1013 - RNA, 25 nt, Artificial Sequence
  Description of Artificial Sequence: Synthetic oligonucleotide
aaaguuaaagcaaccaacuacaggc

SEQ ID NO: 1014 - RNA, 25 nt, Artificial Sequence
  Description of Artificial Sequence: Synthetic oligonucleotide
aaguuaaagcaaccaacuuaaggcc

SEQ ID NO: 1015 - RNA, 25 nt, Artificial Sequence
  Description of Artificial Sequence: Synthetic oligonucleotide
guuaaagcaaccaacuucaagccca

SEQ ID NO: 1016 - RNA, 25 nt, Artificial Sequence
  Description of Artificial Sequence: Synthetic oligonucleotide
uuaaagcaaccaacuucagacccaa

SEQ ID NO: 1017 - RNA, 25 nt, Artificial Sequence
  Description of Artificial Sequence: Synthetic oligonucleotide
uaaagcaaccaacuucaggaccaau

SEQ ID NO: 1018 - RNA, 25 nt, Artificial Sequence
  Description of Artificial Sequence: Synthetic oligonucleotide
aaagcaaccaacuucaggcacaaua

SEQ ID NO: 1019 - RNA, 25 nt, Artificial Sequence
  Description of Artificial Sequence: Synthetic oligonucleotide
aagcaaccaacuucaggccaaauau

SEQ ID NO: 1020 - RNA, 25 nt, Artificial Sequence
  Description of Artificial Sequence: Synthetic oligonucleotide
agcaaccaacuucaggcccaauauu

SEQ ID NO: 1021 - RNA, 25 nt, Artificial Sequence
  Description of Artificial Sequence: Synthetic oligonucleotide
gcaaccaacuucaggcccaauauug

SEQ ID NO: 1022 - RNA, 25 nt, Artificial Sequence
  Description of Artificial Sequence: Synthetic oligonucleotide
aaccaacuucaggcccaauauugua

SEQ ID NO: 1023 - RNA, 25 nt, Artificial Sequence
  Description of Artificial Sequence: Synthetic oligonucleotide
accaacuucaggcccaauaauguaa

SEQ ID NO: 1024 - RNA, 25 nt, Artificial Sequence
  Description of Artificial Sequence: Synthetic oligonucleotide
ccaacuucaggcccaauauaguaau

SEQ ID NO: 1025 - RNA, 25 nt, Artificial Sequence
  Description of Artificial Sequence: Synthetic oligonucleotide
caacuucaggcccaauauuauaauu

SEQ ID NO: 1026 - RNA, 25 nt, Artificial Sequence
  Description of Artificial Sequence: Synthetic oligonucleotide
aacuucaggcccaauauugaaauuu

SEQ ID NO: 1027 - RNA, 25 nt, Artificial Sequence
  Description of Artificial Sequence: Synthetic oligonucleotide
acuucaggcccaauauuguaauuuc

SEQ ID NO: 1028 - RNA, 25 nt, Artificial Sequence
  Description of Artificial Sequence: Synthetic oligonucleotide
cuucaggcccaauauuguaauuuca

SEQ ID NO: 1029 - RNA, 25 nt, Artificial Sequence
  Description of Artificial Sequence: Synthetic oligonucleotide
uucaggcccaauauuguaaauucag

SEQ ID NO: 1030 - RNA, 25 nt, Artificial Sequence
  Description of Artificial Sequence: Synthetic oligonucleotide
ucaggcccaauauuguaauaucagg

SEQ ID NO: 1031 - RNA, 25 nt, Artificial Sequence
  Description of Artificial Sequence: Synthetic oligonucleotide
caggcccaauauuguaauuacagga

SEQ ID NO: 1032 - RNA, 25 nt, Artificial Sequence
  Description of Artificial Sequence: Synthetic oligonucleotide
aggcccaauauuguaauuuaaggau

SEQ ID NO: 1033 - RNA, 25 nt, Artificial Sequence
  Description of Artificial Sequence: Synthetic oligonucleotide
ggcccaauauuguaauuucaggaug

SEQ ID NO: 1034 - RNA, 25 nt, Artificial Sequence
  Description of Artificial Sequence: Synthetic oligonucleotide
gcccaauauuguaauuucaagaugc

SEQ ID NO: 1035 - RNA, 25 nt, Artificial Sequence
  Description of Artificial Sequence: Synthetic oligonucleotide
cccaauauuguaauuucagaaugcg

SEQ ID NO: 1036 - RNA, 25 nt, Artificial Sequence
  Description of Artificial Sequence: Synthetic oligonucleotide
ccaauauuguaauuucaggaugcga

SEQ ID NO: 1037 - RNA, 25 nt, Artificial Sequence
  Description of Artificial Sequence: Synthetic oligonucleotide
caauauuguaauuucaggaagcgau

SEQ ID NO: 1038 - RNA, 25 nt, Artificial Sequence
  Description of Artificial Sequence: Synthetic oligonucleotide
aauauuguaauuucaggauacgaug

SEQ ID NO: 1039 - RNA, 25 nt, Artificial Sequence
  Description of Artificial Sequence: Synthetic oligonucleotide
auauuguaauuucaggaugagaugu

SEQ ID NO: 1040 - RNA, 25 nt, Artificial Sequence
  Description of Artificial Sequence: Synthetic oligonucleotide
uauuguaauuucaggaugcaauguc

SEQ ID NO: 1041 - RNA, 25 nt, Artificial Sequence
  Description of Artificial Sequence: Synthetic oligonucleotide
auuguaauuucaggaugcgaugucu

SEQ ID NO: 1042 - RNA, 25 nt, Artificial Sequence
  Description of Artificial Sequence: Synthetic oligonucleotide
uuguaauuucaggaugcgaagucua

SEQ ID NO: 1043 - RNA, 25 nt, Artificial Sequence
  Description of Artificial Sequence: Synthetic oligonucleotide
uguaauuucaggaugcgauaucuau

SEQ ID NO: 1044 - RNA, 25 nt, Artificial Sequence
  Description of Artificial Sequence: Synthetic oligonucleotide
guaauuucaggaugcgaugacuaug

SEQ ID NO: 1045 - RNA, 25 nt, Artificial Sequence
  Description of Artificial Sequence: Synthetic oligonucleotide
uaauuucaggaugcgauguauaugc

SEQ ID NO: 1046 - RNA, 25 nt, Artificial Sequence
  Description of Artificial Sequence: Synthetic oligonucleotide
aauuucaggaugcgaugucaaugca

SEQ ID NO: 1047 - RNA, 25 nt, Artificial Sequence
  Description of Artificial Sequence: Synthetic oligonucleotide
auuucaggaugcgaugucuaugcag

SEQ ID NO: 1048 - RNA, 25 nt, Artificial Sequence
  Description of Artificial Sequence: Synthetic oligonucleotide
uuucaggaugcgaugucuaagcaga

SEQ ID NO: 1049 - RNA, 25 nt, Artificial Sequence
  Description of Artificial Sequence: Synthetic oligonucleotide
uucaggaugcgaugucuauacagag

SEQ ID NO: 1050 - RNA, 25 nt, Artificial Sequence
  Description of Artificial Sequence: Synthetic oligonucleotide
ucaggaugcgaugucuaugaagagg

SEQ ID NO: 1051 - RNA, 25 nt, Artificial Sequence
  Description of Artificial Sequence: Synthetic oligonucleotide
caggaugcgaugucuaugcagagga

SEQ ID NO: 1052 - RNA, 25 nt, Artificial Sequence
  Description of Artificial Sequence: Synthetic oligonucleotide
aggaugcgaugucuaugcaaaggau

SEQ ID NO: 1053 - RNA, 25 nt, Artificial Sequence
  Description of Artificial Sequence: Synthetic oligonucleotide
ggaugcgaugucuaugcagaggauu

SEQ ID NO: 1054 - RNA, 25 nt, Artificial Sequence
  Description of Artificial Sequence: Synthetic oligonucleotide
gaugcgaugucuaugcagaagauuc

SEQ ID NO: 1055 - RNA, 25 nt, Artificial Sequence
  Description of Artificial Sequence: Synthetic oligonucleotide
augcgaugucuaugcagagaauucu

SEQ ID NO: 1056 - RNA, 25 nt, Artificial Sequence
  Description of Artificial Sequence: Synthetic oligonucleotide
ugcgaugucuaugcagaggaaacac

SEQ ID NO: 1057 - RNA, 25 nt, Artificial Sequence
  Description of Artificial Sequence: Synthetic oligonucleotide
uuguuccagaugcauuuuaaccaca

SEQ ID NO: 1058 - RNA, 25 nt, Artificial Sequence
  Description of Artificial Sequence: Synthetic oligonucleotide
ggaaacacugaagaguuauagccag

SEQ ID NO: 1059 - RNA, 25 nt, Artificial Sequence
  Description of Artificial Sequence: Synthetic oligonucleotide
gaaacacugaagaguuaucaccagu

SEQ ID NO: 1060 - RNA, 25 nt, Artificial Sequence
  Description of Artificial Sequence: Synthetic oligonucleotide
cacugaagaguuaucgccaauguga

SEQ ID NO: 1061 - RNA, 25 nt, Artificial Sequence
  Description of Artificial Sequence: Synthetic oligonucleotide
gugacccuucagaacgaaaauuaua

SEQ ID NO: 1062 - RNA, 25 nt, Artificial Sequence
  Description of Artificial Sequence: Synthetic oligonucleotide
cccuucagaacgaaaguuaaaugga

SEQ ID NO: 1063 - RNA, 25 nt, Artificial Sequence
  Description of Artificial Sequence: Synthetic oligonucleotide
ccuucagaacgaaaguuauauggaa

SEQ ID NO: 1064 - RNA, 25 nt, Artificial Sequence
  Description of Artificial Sequence: Synthetic oligonucleotide
ucagaacgaaaguuauaugaaaaau

SEQ ID NO: 1065 - RNA, 25 nt, Artificial Sequence
  Description of Artificial Sequence: Synthetic oligonucleotide
cagaacgaaaguuauauggaaaauc

SEQ ID NO: 1066 - RNA, 25 nt, Artificial Sequence
  Description of Artificial Sequence: Synthetic oligonucleotide
agaacgaaaguuauauggaaaauca

SEQ ID NO: 1067 - RNA, 25 nt, Artificial Sequence
  Description of Artificial Sequence: Synthetic oligonucleotide
gaacgaaaguuauauggaaaaucac

SEQ ID NO: 1068 - RNA, 25 nt, Artificial Sequence
  Description of Artificial Sequence: Synthetic oligonucleotide
aacgaaaguuauauggaaaaucacc

SEQ ID NO: 1069 - RNA, 25 nt, Artificial Sequence
  Description of Artificial Sequence: Synthetic oligonucleotide
cgaaaguuauauggaaaauaaccac

SEQ ID NO: 1070 - RNA, 25 nt, Artificial Sequence
  Description of Artificial Sequence: Synthetic oligonucleotide
gaaaguuauauggaaaaucaccacu

SEQ ID NO: 1071 - RNA, 25 nt, Artificial Sequence
  Description of Artificial Sequence: Synthetic oligonucleotide
aaaguuauauggaaaaucaacacuc

SEQ ID NO: 1072 - RNA, 25 nt, Artificial Sequence
  Description of Artificial Sequence: Synthetic oligonucleotide
aaaaauguucucaaaaaugacaaca

SEQ ID NO: 1073 - RNA, 25 nt, Artificial Sequence
  Description of Artificial Sequence: Synthetic oligonucleotide
guucucaaaaaugacaacaauugaa

SEQ ID NO: 1074 - RNA, 25 nt, Artificial Sequence
  Description of Artificial Sequence: Synthetic oligonucleotide
caaaaaugacaacacuugaagcaug

SEQ ID NO: 1075 - RNA, 25 nt, Artificial Sequence
  Description of Artificial Sequence: Synthetic oligonucleotide
augacaacacuugaagcauaguguu

SEQ ID NO: 1076 - RNA, 25 nt, Artificial Sequence
  Description of Artificial Sequence: Synthetic oligonucleotide
acaacacuugaagcaugguauuuca

SEQ ID NO: 1077 - RNA, 25 nt, Artificial Sequence
  Description of Artificial Sequence: Synthetic oligonucleotide
caacacuugaagcauggugauucag

SEQ ID NO: 1078 - RNA, 25 nt, Artificial Sequence
  Description of Artificial Sequence: Synthetic oligonucleotide
aacacuugaagcaugguguaucaga

SEQ ID NO: 1079 - RNA, 25 nt, Artificial Sequence
  Description of Artificial Sequence: Synthetic oligonucleotide
acacuugaagcaugguguuacagaa

SEQ ID NO: 1080 - RNA, 25 nt, Artificial Sequence
  Description of Artificial Sequence: Synthetic oligonucleotide
cacuugaagcaugguguuuaagaac

SEQ ID NO: 1081 - RNA, 25 nt, Artificial Sequence
  Description of Artificial Sequence: Synthetic oligonucleotide
cuugaagcaugguguuucaaaacug

SEQ ID NO: 1082 - RNA, 25 nt, Artificial Sequence
  Description of Artificial Sequence: Synthetic oligonucleotide
uugaagcaugguguuucagaacuga

SEQ ID NO: 1083 - RNA, 25 nt, Artificial Sequence
  Description of Artificial Sequence: Synthetic oligonucleotide
ugaagcaugguguuucagaacugag

SEQ ID NO: 1084 - RNA, 25 nt, Artificial Sequence
  Description of Artificial Sequence: Synthetic oligonucleotide
gaagcaugguguuucagaaaugaga

SEQ ID NO: 1085 - RNA, 25 nt, Artificial Sequence
  Description of Artificial Sequence: Synthetic oligonucleotide
caugguguuucagaacugaaaccuc

SEQ ID NO: 1086 - RNA, 25 nt, Artificial Sequence
  Description of Artificial Sequence: Synthetic oligonucleotide
uguuucagaacugagaccuauacau

SEQ ID NO: 1087 - RNA, 25 nt, Artificial Sequence
  Description of Artificial Sequence: Synthetic oligonucleotide
acauuuucuuuaaauuuguaauuuu

SEQ ID NO: 1088 - RNA, 25 nt, Artificial Sequence
  Description of Artificial Sequence: Synthetic oligonucleotide
auuuucuuuaaauuugugaauuuca

SEQ ID NO: 1089 - RNA, 25 nt, Artificial Sequence
  Description of Artificial Sequence: Synthetic oligonucleotide
uuuaaauuugugauuuucaaauuuu

SEQ ID NO: 1090 - RNA, 25 nt, Artificial Sequence
  Description of Artificial Sequence: Synthetic oligonucleotide
aauuugugauuuucacauuauucgu

SEQ ID NO: 1091 - RNA, 25 nt, Artificial Sequence
  Description of Artificial Sequence: Synthetic oligonucleotide
uuugugauuuucacauuuuacgucu

SEQ ID NO: 1092 - RNA, 25 nt, Artificial Sequence
  Description of Artificial Sequence: Synthetic oligonucleotide
guuuaacugauuauggaauaguucu

SEQ ID NO: 1093 - RNA, 25 nt, Artificial Sequence
  Description of Artificial Sequence: Synthetic oligonucleotide
uuuaacugauuauggaauaauucuu

SEQ ID NO: 1094 - RNA, 25 nt, Artificial Sequence
  Description of Artificial Sequence: Synthetic oligonucleotide
uaacugauuauggaauaguacuuuc

SEQ ID NO: 1095 - RNA, 25 nt, Artificial Sequence
  Description of Artificial Sequence: Synthetic oligonucleotide
aacugauuauggaauaguuauuucu

SEQ ID NO: 1096 - RNA, 25 nt, Artificial Sequence
  Description of Artificial Sequence: Synthetic oligonucleotide
acugauuauggaauaguucauucuc

SEQ ID NO: 1097 - RNA, 25 nt, Artificial Sequence
  Description of Artificial Sequence: Synthetic oligonucleotide
cugauuauggaauaguucuaucucc

SEQ ID NO: 1098 - RNA, 25 nt, Artificial Sequence
  Description of Artificial Sequence: Synthetic oligonucleotide
cagauauuaauuuuccauaaaucug

SEQ ID NO: 1099 - RNA, 25 nt, Artificial Sequence
  Description of Artificial Sequence: Synthetic oligonucleotide
gauauuaauuuuccauagaacugga

SEQ ID NO: 1100 - RNA, 25 nt, Artificial Sequence
  Description of Artificial Sequence: Synthetic oligonucleotide
cuucucagacagcauuggaauuccu

SEQ ID NO: 1101 - RNA, 25 nt, Artificial Sequence
  Description of Artificial Sequence: Synthetic oligonucleotide
cucagacagcauuggauuuacuaaa

SEQ ID NO: 1102 - RNA, 25 nt, Artificial Sequence
  Description of Artificial Sequence: Synthetic oligonucleotide
ucagacagcauuggauuucauaaag

SEQ ID NO: 1103 - RNA, 25 nt, Artificial Sequence
  Description of Artificial Sequence: Synthetic oligonucleotide
agaaaagugauucagugauaucaga

SEQ ID NO: 1104 - RNA, 25 nt, Artificial Sequence
  Description of Artificial Sequence: Synthetic oligonucleotide
aagugauucagugauuucaaauaga

SEQ ID NO: 1105 - RNA, 25 nt, Artificial Sequence
  Description of Artificial Sequence: Synthetic oligonucleotide
ggaaagcauaugucaguugauuaaa

SEQ ID NO: 1106 - RNA, 25 nt, Artificial Sequence
  Description of Artificial Sequence: Synthetic oligonucleotide
gaaagcauaugucaguuguauaaaa

SEQ ID NO: 1107 - RNA, 25 nt, Artificial Sequence
  Description of Artificial Sequence: Synthetic oligonucleotide
uaugucaguuguuuaaaacacaaua

SEQ ID NO: 1108 - RNA, 25 nt, Artificial Sequence
  Description of Artificial Sequence: Synthetic oligonucleotide
augucaguuguuuaaaaccaaauau

SEQ ID NO: 1109 - RNA, 25 nt, Artificial Sequence
  Description of Artificial Sequence: Synthetic oligonucleotide
ugucaguuguuuaaaacccaauauc

SEQ ID NO: 1110 - RNA, 25 nt, Artificial Sequence
  Description of Artificial Sequence: Synthetic oligonucleotide
gucaguuguuuaaaacccaauaucu

SEQ ID NO: 1111 - RNA, 25 nt, Artificial Sequence
  Description of Artificial Sequence: Synthetic oligonucleotide
aguuguuuaaaacccaauaacuauu

SEQ ID NO: 1112 - RNA, 25 nt, Artificial Sequence
  Description of Artificial Sequence: Synthetic oligonucleotide
guuguuuaaaacccaauauauauuu

SEQ ID NO: 1113 - RNA, 25 nt, Artificial Sequence
  Description of Artificial Sequence: Synthetic oligonucleotide
uuguuuaaaacccaauaucaauuuu

SEQ ID NO: 1114 - RNA, 25 nt, Artificial Sequence
  Description of Artificial Sequence: Synthetic oligonucleotide
uguuuaaaacccaauaucuauuuuu

SEQ ID NO: 1115 - RNA, 25 nt, Artificial Sequence
  Description of Artificial Sequence: Synthetic oligonucleotide
guuuaaaacccaauaucuaauuuuu

SEQ ID NO: 1116 - RNA, 25 nt, Artificial Sequence
  Description of Artificial Sequence: Synthetic oligonucleotide
ugaugaaguauauuuuuuaaugcca

SEQ ID NO: 1117 - RNA, 25 nt, Artificial Sequence
  Description of Artificial Sequence: Synthetic oligonucleotide
gaugaaguauauuuuuuauagccau

SEQ ID NO: 1118 - RNA, 25 nt, Artificial Sequence
  Description of Artificial Sequence: Synthetic oligonucleotide
augaaguauauuuuuuauuaccauu

SEQ ID NO: 1119 - RNA, 25 nt, Artificial Sequence
  Description of Artificial Sequence: Synthetic oligonucleotide
gaaguauauuuuuuauugcaauuuu

SEQ ID NO: 1120 - RNA, 25 nt, Artificial Sequence
  Description of Artificial Sequence: Synthetic oligonucleotide
aguauauuuuuuauugccaauuugu

SEQ ID NO: 1121 - RNA, 25 nt, Artificial Sequence
  Description of Artificial Sequence: Synthetic oligonucleotide
auugccauuuuguccuuugauuaua

SEQ ID NO: 1122 - RNA, 25 nt, Artificial Sequence
  Description of Artificial Sequence: Synthetic oligonucleotide
ugccauuuuguccuuugauaauauu

SEQ ID NO: 1123 - RNA, 25 nt, Artificial Sequence
  Description of Artificial Sequence: Synthetic oligonucleotide
ggaaguugacuaaacuugaaaaaug

SEQ ID NO: 1124 - RNA, 25 nt, Artificial Sequence
  Description of Artificial Sequence: Synthetic oligonucleotide
aaguugacuaaacuugaaaaauguu

SEQ ID NO: 1125 - RNA, 25 nt, Artificial Sequence
  Description of Artificial Sequence: Synthetic oligonucleotide
guugacuaaacuugaaaaaaguuuu

SEQ ID NO: 1126 - RNA, 25 nt, Artificial Sequence
  Description of Artificial Sequence: Synthetic oligonucleotide
uugacuaaacuugaaaaauauuuuu

SEQ ID NO: 1127 - RNA, 25 nt, Artificial Sequence
  Description of Artificial Sequence: Synthetic oligonucleotide
gacuaaacuugaaaaauguauuuaa

SEQ ID NO: 1128 - RNA, 25 nt, Artificial Sequence
  Description of Artificial Sequence: Synthetic oligonucleotide
acuaaacuugaaaaauguuauuaaa

SEQ ID NO: 1129 - RNA, 25 nt, Artificial Sequence
  Description of Artificial Sequence: Synthetic oligonucleotide
cuaaacuugaaaaauguuuauaaaa

SEQ ID NO: 1130 - RNA, 25 nt, Artificial Sequence
  Description of Artificial Sequence: Synthetic oligonucleotide
cuugaaaaauguuuuuaaaacugug

SEQ ID NO: 1131 - RNA, 25 nt, Artificial Sequence
  Description of Artificial Sequence: Synthetic oligonucleotide
uugaaaaauguuuuuaaaaauguga

SEQ ID NO: 1132 - RNA, 25 nt, Artificial Sequence
  Description of Artificial Sequence: Synthetic oligonucleotide
gaaaaauguuuuuaaaacuaugaau

SEQ ID NO: 1133 - RNA, 25 nt, Artificial Sequence
  Description of Artificial Sequence: Synthetic oligonucleotide
aaaaauguuuuuaaaacugagaaua

SEQ ID NO: 1134 - RNA, 25 nt, Artificial Sequence
  Description of Artificial Sequence: Synthetic oligonucleotide
aaaauguuuuuaaaacuguaaauaa

SEQ ID NO: 1135 - RNA, 25 nt, Artificial Sequence
  Description of Artificial Sequence: Synthetic oligonucleotide
aaauguuuuuaaaacugugaauaaa

SEQ ID NO: 1136 - RNA, 25 nt, Artificial Sequence
  Description of Artificial Sequence: Synthetic oligonucleotide
aauguuuuuaaaacugugaauaaau

SEQ ID NO: 1137 - RNA, 25 nt, Artificial Sequence
  Description of Artificial Sequence: Synthetic oligonucleotide
guuuuuaaaacugugaauaaaugga

SEQ ID NO: 1138 - RNA, 25 nt, Artificial Sequence
  Description of Artificial Sequence: Synthetic oligonucleotide
uuuuuaaaacugugaauaaauggaa

SEQ ID NO: 1139 - RNA, 25 nt, Artificial Sequence
  Description of Artificial Sequence: Synthetic oligonucleotide
uaaaacugugaauaaauggaagcua

SEQ ID NO: 1140 - RNA, 25 nt, Artificial Sequence
  Description of Artificial Sequence: Synthetic oligonucleotide
aaaacugugaauaaauggaagcuac

SEQ ID NO: 1141 - RNA, 25 nt, Artificial Sequence
  Description of Artificial Sequence: Synthetic oligonucleotide
aaacugugaauaaauggaaacuacu

SEQ ID NO: 1142 - RNA, 25 nt, Artificial Sequence
  Description of Artificial Sequence: Synthetic oligonucleotide
aacugugaauaaauggaagauacuu

SEQ ID NO: 1143 - RNA, 25 nt, Artificial Sequence
  Description of Artificial Sequence: Synthetic oligonucleotide
cugugaauaaauggaagcuacuuug

SEQ ID NO: 1144 - RNA, 25 nt, Artificial Sequence
  Description of Artificial Sequence: Synthetic oligonucleotide
ugugaauaaauggaagcuaauuuga

SEQ ID NO: 1145 - RNA, 25 nt, Artificial Sequence
  Description of Artificial Sequence: Synthetic oligonucleotide
gugaauaaauggaagcuacauugac

SEQ ID NO: 1146 - RNA, 25 nt, Artificial Sequence
  Description of Artificial Sequence: Synthetic oligonucleotide
ugaauaaauggaagcuacuaugacu

SEQ ID NO: 1147 - RNA, 25 nt, Artificial Sequence
  Description of Artificial Sequence: Synthetic oligonucleotide
gaauaaauggaagcuacuuagacua

SEQ ID NO: 1148 - RNA, 25 nt, Artificial Sequence
  Description of Artificial Sequence: Synthetic oligonucleotide
aauaaauggaagcuacuuuaacuag

SEQ ID NO: 1149 - RNA, 25 nt, Artificial Sequence
  Description of Artificial Sequence: Synthetic oligonucleotide
uaaauggaagcuacuuugaauaguu

SEQ ID NO: 1150 - RNA, 25 nt, Artificial Sequence
  Description of Artificial Sequence: Synthetic oligonucleotide
aaauggaagcuacuuugacaaguuu

SEQ ID NO: 1151 - RNA, 25 nt, Artificial Sequence
  Description of Artificial Sequence: Synthetic oligonucleotide
auggaagcuacuuugacuaauuuca

SEQ ID NO: 1152 - RNA, 25 nt, Artificial Sequence
  Description of Artificial Sequence: Synthetic oligonucleotide
ggaagcuacuuugacuaguaucaga

SEQ ID NO: 1153 - RNA, 27 nt, Artificial Sequence
  Description of Artificial Sequence: Synthetic oligonucleotide
ucacaugguagauccagagcugcgcca

SEQ ID NO: 1154 - RNA, 27 nt, Artificial Sequence
  Description of Artificial Sequence: Synthetic oligonucleotide
uuucauaggguagauccagagcugcgc

SEQ ID NO: 1155 - RNA, 27 nt, Artificial Sequence
  Description of Artificial Sequence: Synthetic oligonucleotide
auuucucaggguagauccagagcugcg

SEQ ID NO: 1156 - RNA, 27 nt, Artificial Sequence
  Description of Artificial Sequence: Synthetic oligonucleotide
gauuuuacaggguagauccagagcugc

SEQ ID NO: 1157 - RNA, 27 nt, Artificial Sequence
  Description of Artificial Sequence: Synthetic oligonucleotide
ggauuucacaggguagauccagagcug

SEQ ID NO: 1158 - RNA, 27 nt, Artificial Sequence
  Description of Artificial Sequence: Synthetic oligonucleotide
aggauuucacaggguagauccagagcu

SEQ ID NO: 1159 - RNA, 27 nt, Artificial Sequence
  Description of Artificial Sequence: Synthetic oligonucleotide
caggauuucacaggguagauccagagc

SEQ ID NO: 1160 - RNA, 27 nt, Artificial Sequence
  Description of Artificial Sequence: Synthetic oligonucleotide
gcagguuuucacaggguagauccagag

SEQ ID NO: 1161 - RNA, 27 nt, Artificial Sequence
  Description of Artificial Sequence: Synthetic oligonucleotide
ugcaguauuucacaggguagauccaga

SEQ ID NO: 1162 - RNA, 27 nt, Artificial Sequence
  Description of Artificial Sequence: Synthetic oligonucleotide
uugcaugauuucacaggguagauccag

SEQ ID NO: 1163 - RNA, 27 nt, Artificial Sequence
  Description of Artificial Sequence: Synthetic oligonucleotide
cuugcuggauuucacaggguagaucca

SEQ ID NO: 1164 - RNA, 27 nt, Artificial Sequence
  Description of Artificial Sequence: Synthetic oligonucleotide
ccuuguaggauuucacaggguagaucc

SEQ ID NO: 1165 - RNA, 27 nt, Artificial Sequence
  Description of Artificial Sequence: Synthetic oligonucleotide
cccuuucaggauuucacaggguagauc

SEQ ID NO: 1166 - RNA, 27 nt, Artificial Sequence
  Description of Artificial Sequence: Synthetic oligonucleotide
ccccuugcaggauuucacaggguagau

SEQ ID NO: 1167 - RNA, 27 nt, Artificial Sequence
  Description of Artificial Sequence: Synthetic oligonucleotide
accccuuugcaggauuucacaggguag

SEQ ID NO: 1168 - RNA, 27 nt, Artificial Sequence
  Description of Artificial Sequence: Synthetic oligonucleotide
cacccucuugcaggauuucacagggua

SEQ ID NO: 1169 - RNA, 27 nt, Artificial Sequence
  Description of Artificial Sequence: Synthetic oligonucleotide
gcaccuccuugcaggauuucacagggu

SEQ ID NO: 1170 - RNA, 27 nt, Artificial Sequence
  Description of Artificial Sequence: Synthetic oligonucleotide
accgguacccccuugcaggauuucaca

SEQ ID NO: 1171 - RNA, 27 nt, Artificial Sequence
  Description of Artificial Sequence: Synthetic oligonucleotide
ucaccugcacccccuugcaggauuuca

SEQ ID NO: 1172 - RNA, 27 nt, Artificial Sequence
  Description of Artificial Sequence: Synthetic oligonucleotide
caagcuaaaaccugucccgcagguugc

SEQ ID NO: 1173 - RNA, 27 nt, Artificial Sequence
  Description of Artificial Sequence: Synthetic oligonucleotide
acaagucaaaaccugucccgcagguug

SEQ ID NO: 1174 - RNA, 27 nt, Artificial Sequence
  Description of Artificial Sequence: Synthetic oligonucleotide
cacaauccaaaaccugucccgcagguu

SEQ ID NO: 1175 - RNA, 27 nt, Artificial Sequence
  Description of Artificial Sequence: Synthetic oligonucleotide
ucacaugccaaaaccugucccgcaggu

SEQ ID NO: 1176 - RNA, 27 nt, Artificial Sequence
  Description of Artificial Sequence: Synthetic oligonucleotide
gaucauaagccaaaaccugucccgcag

SEQ ID NO: 1177 - RNA, 27 nt, Artificial Sequence
  Description of Artificial Sequence: Synthetic oligonucleotide
ugaucucaagccaaaaccugucccgca

SEQ ID NO: 1178 - RNA, 27 nt, Artificial Sequence
  Description of Artificial Sequence: Synthetic oligonucleotide
uugauuacaagccaaaaccugucccgc

SEQ ID NO: 1179 - RNA, 27 nt, Artificial Sequence
  Description of Artificial Sequence: Synthetic oligonucleotide
guugaucacaagccaaaaccugucccg

SEQ ID NO: 1180 - RNA, 27 nt, Artificial Sequence
  Description of Artificial Sequence: Synthetic oligonucleotide
gguuguucacaagccaaaaccuguccc

SEQ ID NO: 1181 - RNA, 27 nt, Artificial Sequence
  Description of Artificial Sequence: Synthetic oligonucleotide
ugguuuaucacaagccaaaaccugucc

SEQ ID NO: 1182 - RNA, 27 nt, Artificial Sequence
  Description of Artificial Sequence: Synthetic oligonucleotide
cugguugaucacaagccaaaaccuguc

SEQ ID NO: 1183 - RNA, 27 nt, Artificial Sequence
  Description of Artificial Sequence: Synthetic oligonucleotide
ccugguugaucacaagccaaaaccugu

SEQ ID NO: 1184 - RNA, 27 nt, Artificial Sequence
  Description of Artificial Sequence: Synthetic oligonucleotide
uccuguuugaucacaagccaaaaccug

SEQ ID NO: 1185 - RNA, 27 nt, Artificial Sequence
  Description of Artificial Sequence: Synthetic oligonucleotide
cuccuuguugaucacaagccaaaaccu

SEQ ID NO: 1186 - RNA, 27 nt, Artificial Sequence
  Description of Artificial Sequence: Synthetic oligonucleotide
cccucuugguugaucacaagccaaaac

SEQ ID NO: 1187 - RNA, 27 nt, Artificial Sequence
  Description of Artificial Sequence: Synthetic oligonucleotide
ucccuucugguugaucacaagccaaaa

SEQ ID NO: 1188 - RNA, 27 nt, Artificial Sequence
  Description of Artificial Sequence: Synthetic oligonucleotide
uuuccuuccugguugaucacaagccaa

SEQ ID NO: 1189 - RNA, 27 nt, Artificial Sequence
  Description of Artificial Sequence: Synthetic oligonucleotide
guuucucuccugguugaucacaagcca

SEQ ID NO: 1190 - RNA, 27 nt, Artificial Sequence
  Description of Artificial Sequence: Synthetic oligonucleotide
uguuuuccuccugguugaucacaagcc

SEQ ID NO: 1191 - RNA, 27 nt, Artificial Sequence
  Description of Artificial Sequence: Synthetic oligonucleotide
auguuucccuccugguugaucacaagc

SEQ ID NO: 1192 - RNA, 27 nt, Artificial Sequence
  Description of Artificial Sequence: Synthetic oligonucleotide
cauguuucccuccugguugaucacaag

SEQ ID NO: 1193 - RNA, 27 nt, Artificial Sequence
  Description of Artificial Sequence: Synthetic oligonucleotide
ccauguuucccuccugguugaucacaa

SEQ ID NO: 1194 - RNA, 27 nt, Artificial Sequence
  Description of Artificial Sequence: Synthetic oligonucleotide
accauuuuucccuccugguugaucaca

SEQ ID NO: 1195 - RNA, 27 nt, Artificial Sequence
  Description of Artificial Sequence: Synthetic oligonucleotide
uaaccuuguuucccuccugguugauca

SEQ ID NO: 1196 - RNA, 27 nt, Artificial Sequence
  Description of Artificial Sequence: Synthetic oligonucleotide
guaacuauguuucccuccugguugauc

SEQ ID NO: 1197 - RNA, 27 nt, Artificial Sequence
  Description of Artificial Sequence: Synthetic oligonucleotide
aguaaucauguuucccuccugguugau

SEQ ID NO: 1198 - RNA, 27 nt, Artificial Sequence
  Description of Artificial Sequence: Synthetic oligonucleotide
caguauccauguuucccuccugguuga

SEQ ID NO: 1199 - RNA, 27 nt, Artificial Sequence
  Description of Artificial Sequence: Synthetic oligonucleotide
gcaguuaccauguuucccuccugguug

SEQ ID NO: 1200 - RNA, 27 nt, Artificial Sequence
  Description of Artificial Sequence: Synthetic oligonucleotide
agcaguaaccauguuucccuccugguu

SEQ ID NO: 1201 - RNA, 27 nt, Artificial Sequence
  Description of Artificial Sequence: Synthetic oligonucleotide
gagcauuaaccauguuucccuccuggu

SEQ ID NO: 1202 - RNA, 27 nt, Artificial Sequence
  Description of Artificial Sequence: Synthetic oligonucleotide
cgagcuguaaccauguuucccuccugg

SEQ ID NO: 1203 - RNA, 27 nt, Artificial Sequence
  Description of Artificial Sequence: Synthetic oligonucleotide
gcgaguaguaaccauguuucccuccug

SEQ ID NO: 1204 - RNA, 27 nt, Artificial Sequence
  Description of Artificial Sequence: Synthetic oligonucleotide
ggcgaucaguaaccauguuucccuccu

SEQ ID NO: 1205 - RNA, 27 nt, Artificial Sequence
  Description of Artificial Sequence: Synthetic oligonucleotide
cuggcuagcaguaaccauguuucccuc

SEQ ID NO: 1206 - RNA, 27 nt, Artificial Sequence
  Description of Artificial Sequence: Synthetic oligonucleotide
ccuggugagcaguaaccauguuucccu

SEQ ID NO: 1207 - RNA, 27 nt, Artificial Sequence
  Description of Artificial Sequence: Synthetic oligonucleotide
uccugucgagcaguaaccauguuuccc

SEQ ID NO: 1208 - RNA, 27 nt, Artificial Sequence
  Description of Artificial Sequence: Synthetic oligonucleotide
uuccuugcgagcaguaaccauguuucc

SEQ ID NO: 1209 - RNA, 27 nt, Artificial Sequence
  Description of Artificial Sequence: Synthetic oligonucleotide
guuccuggcgagcaguaaccauguuuc

SEQ ID NO: 1210 - RNA, 27 nt, Artificial Sequence
  Description of Artificial Sequence: Synthetic oligonucleotide
gguucuuggcgagcaguaaccauguuu

SEQ ID NO: 1211 - RNA, 27 nt, Artificial Sequence
  Description of Artificial Sequence: Synthetic oligonucleotide
agguuucuggcgagcaguaaccauguu

SEQ ID NO: 1212 - RNA, 27 nt, Artificial Sequence
  Description of Artificial Sequence: Synthetic oligonucleotide
gcgaguuuccuggcgagcaguaaccau

SEQ ID NO: 1213 - RNA, 27 nt, Artificial Sequence
  Description of Artificial Sequence: Synthetic oligonucleotide
aucaguaccaggcgagguuccuggcga

SEQ ID NO: 1214 - RNA, 27 nt, Artificial Sequence
  Description of Artificial Sequence: Synthetic oligonucleotide
gaaauuaggaccaggcgagguuccugg

SEQ ID NO: 1215 - RNA, 27 nt, Artificial Sequence
  Description of Artificial Sequence: Synthetic oligonucleotide
ucagguaaaucaggaccaggcgagguu

SEQ ID NO: 1216 - RNA, 27 nt, Artificial Sequence
  Description of Artificial Sequence: Synthetic oligonucleotide
gucagugaaaucaggaccaggcgaggu

SEQ ID NO: 1217 - RNA, 27 nt, Artificial Sequence
  Description of Artificial Sequence: Synthetic oligonucleotide
cagguuagggaaaucaggaccaggcga

SEQ ID NO: 1218 - RNA, 27 nt, Artificial Sequence
  Description of Artificial Sequence: Synthetic oligonucleotide
cgcaguucagggaaaucaggaccaggc

SEQ ID NO: 1219 - RNA, 27 nt, Artificial Sequence
  Description of Artificial Sequence: Synthetic oligonucleotide
ucgcaugucagggaaaucaggaccagg

SEQ ID NO: 1220 - RNA, 27 nt, Artificial Sequence
  Description of Artificial Sequence: Synthetic oligonucleotide
caucguaggucagggaaaucaggacca

SEQ ID NO: 1221 - RNA, 27 nt, Artificial Sequence
  Description of Artificial Sequence: Synthetic oligonucleotide
accauugcaggucagggaaaucaggac

SEQ ID NO: 1222 - RNA, 27 nt, Artificial Sequence
  Description of Artificial Sequence: Synthetic oligonucleotide
ucagguugucaccaucgcaggucaggg

SEQ ID NO: 1223 - RNA, 27 nt, Artificial Sequence
  Description of Artificial Sequence: Synthetic oligonucleotide
agaguuagggugucaccaucgcagguc

SEQ ID NO: 1224 - RNA, 27 nt, Artificial Sequence
  Description of Artificial Sequence: Synthetic oligonucleotide
ugagauucagggugucaccaucgcagg

SEQ ID NO: 1225 - RNA, 27 nt, Artificial Sequence
  Description of Artificial Sequence: Synthetic oligonucleotide
cugagugucagggugucaccaucgcag

SEQ ID NO: 1226 - RNA, 27 nt, Artificial Sequence
  Description of Artificial Sequence: Synthetic oligonucleotide
acugauagucagggugucaccaucgca

SEQ ID NO: 1227 - RNA, 27 nt, Artificial Sequence
  Description of Artificial Sequence: Synthetic oligonucleotide
cacugugagucagggugucaccaucgc

SEQ ID NO: 1228 - RNA, 27 nt, Artificial Sequence
  Description of Artificial Sequence: Synthetic oligonucleotide
gcacuuagagucagggugucaccaucg

SEQ ID NO: 1229 - RNA, 27 nt, Artificial Sequence
  Description of Artificial Sequence: Synthetic oligonucleotide
ugcacugagagucagggugucaccauc

SEQ ID NO: 1230 - RNA, 27 nt, Artificial Sequence
  Description of Artificial Sequence: Synthetic oligonucleotide
cugcauugagagucagggugucaccau

SEQ ID NO: 1231 - RNA, 27 nt, Artificial Sequence
  Description of Artificial Sequence: Synthetic oligonucleotide
gcugcucugagagucagggugucacca

SEQ ID NO: 1232 - RNA, 27 nt, Artificial Sequence
  Description of Artificial Sequence: Synthetic oligonucleotide
ggcuguacugagagucagggugucacc

SEQ ID NO: 1233 - RNA, 27 nt, Artificial Sequence
  Description of Artificial Sequence: Synthetic oligonucleotide
aggcuucacugagagucagggugucac

SEQ ID NO: 1234 - RNA, 27 nt, Artificial Sequence
  Description of Artificial Sequence: Synthetic oligonucleotide
uaggcugcacugagagucaggguguca

SEQ ID NO: 1235 - RNA, 27 nt, Artificial Sequence
  Description of Artificial Sequence: Synthetic oligonucleotide
guagguugcacugagagucaggguguc

SEQ ID NO: 1236 - RNA, 27 nt, Artificial Sequence
  Description of Artificial Sequence: Synthetic oligonucleotide
uguagucugcacugagagucagggugu

SEQ ID NO: 1237 - RNA, 27 nt, Artificial Sequence
  Description of Artificial Sequence: Synthetic oligonucleotide
guguaugcugcacugagagucagggug

SEQ ID NO: 1238 - RNA, 27 nt, Artificial Sequence
  Description of Artificial Sequence: Synthetic oligonucleotide
uguguuggcugcacugagagucagggu

SEQ ID NO: 1239 - RNA, 27 nt, Artificial Sequence
  Description of Artificial Sequence: Synthetic oligonucleotide
uuguguaggcugcacugagagucaggg

SEQ ID NO: 1240 - RNA, 27 nt, Artificial Sequence
  Description of Artificial Sequence: Synthetic oligonucleotide
uuuguuuaggcugcacugagagucagg

SEQ ID NO: 1241 - RNA, 27 nt, Artificial Sequence
  Description of Artificial Sequence: Synthetic oligonucleotide
cuuuguguaggcugcacugagagucag

SEQ ID NO: 1242 - RNA, 27 nt, Artificial Sequence
  Description of Artificial Sequence: Synthetic oligonucleotide
ccuuuuuguaggcugcacugagaguca

SEQ ID NO: 1243 - RNA, 27 nt, Artificial Sequence
  Description of Artificial Sequence: Synthetic oligonucleotide
uccuuuguguaggcugcacugagaguc

SEQ ID NO: 1244 - RNA, 27 nt, Artificial Sequence
  Description of Artificial Sequence: Synthetic oligonucleotide
guccuuuguguaggcugcacugagagu

SEQ ID NO: 1245 - RNA, 27 nt, Artificial Sequence
  Description of Artificial Sequence: Synthetic oligonucleotide
aggucuuuuguguaggcugcacugaga

SEQ ID NO: 1246 - RNA, 27 nt, Artificial Sequence
  Description of Artificial Sequence: Synthetic oligonucleotide
uagguucuuuguguaggcugcacugag

SEQ ID NO: 1247 - RNA, 27 nt, Artificial Sequence
  Description of Artificial Sequence: Synthetic oligonucleotide
guagguccuuuguguaggcugcacuga

SEQ ID NO: 1248 - RNA, 27 nt, Artificial Sequence
  Description of Artificial Sequence: Synthetic oligonucleotide
aguaguuccuuuguguaggcugcacug

SEQ ID NO: 1249 - RNA, 27 nt, Artificial Sequence
  Description of Artificial Sequence: Synthetic oligonucleotide
uaguauguccuuuguguaggcugcacu

SEQ ID NO: 1250 - RNA, 27 nt, Artificial Sequence
  Description of Artificial Sequence: Synthetic oligonucleotide
guaguugguccuuuguguaggcugcac

SEQ ID NO: 1251 - RNA, 27 nt, Artificial Sequence
  Description of Artificial Sequence: Synthetic oligonucleotide
aguaguagguccuuuguguaggcugca

SEQ ID NO: 1252 - RNA, 27 nt, Artificial Sequence
  Description of Artificial Sequence: Synthetic oligonucleotide
caguauuagguccuuuguguaggcugc

SEQ ID NO: 1253 - RNA, 27 nt, Artificial Sequence
  Description of Artificial Sequence: Synthetic oligonucleotide
gcaguuguagguccuuuguguaggcug

SEQ ID NO: 1254 - RNA, 27 nt, Artificial Sequence
  Description of Artificial Sequence: Synthetic oligonucleotide
auagguaguaguagguccuuuguguag

SEQ ID NO: 1255 - RNA, 27 nt, Artificial Sequence
  Description of Artificial Sequence: Synthetic oligonucleotide
gauagucaguaguagguccuuugugua

SEQ ID NO: 1256 - RNA, 27 nt, Artificial Sequence
  Description of Artificial Sequence: Synthetic oligonucleotide
ugauaugcaguaguagguccuuugugu

SEQ ID NO: 1257 - RNA, 27 nt, Artificial Sequence
  Description of Artificial Sequence: Synthetic oligonucleotide
uugauuggcaguaguagguccuuugug

SEQ ID NO: 1258 - RNA, 27 nt, Artificial Sequence
  Description of Artificial Sequence: Synthetic oligonucleotide
uuugauaggcaguaguagguccuuugu

SEQ ID NO: 1259 - RNA, 27 nt, Artificial Sequence
  Description of Artificial Sequence: Synthetic oligonucleotide
uuuuguuaggcaguaguagguccuuug

SEQ ID NO: 1260 - RNA, 27 nt, Artificial Sequence
  Description of Artificial Sequence: Synthetic oligonucleotide
guuuuuauaggcaguaguagguccuuu

SEQ ID NO: 1261 - RNA, 27 nt, Artificial Sequence
  Description of Artificial Sequence: Synthetic oligonucleotide
cguuuugauaggcaguaguagguccuu

SEQ ID NO: 1262 - RNA, 27 nt, Artificial Sequence
  Description of Artificial Sequence: Synthetic oligonucleotide
gcguuuugauaggcaguaguagguccu

SEQ ID NO: 1263 - RNA, 27 nt, Artificial Sequence
  Description of Artificial Sequence: Synthetic oligonucleotide
ggcguuuugauaggcaguaguaggucc

SEQ ID NO: 1264 - RNA, 27 nt, Artificial Sequence
  Description of Artificial Sequence: Synthetic oligonucleotide
ugggcuuuuugauaggcaguaguaggu

SEQ ID NO: 1265 - RNA, 27 nt, Artificial Sequence
  Description of Artificial Sequence: Synthetic oligonucleotide
guggguguuuugauaggcaguaguagg

SEQ ID NO: 1266 - RNA, 27 nt, Artificial Sequence
  Description of Artificial Sequence: Synthetic oligonucleotide
gguggucguuuugauaggcaguaguag

SEQ ID NO: 1267 - RNA, 27 nt, Artificial Sequence
  Description of Artificial Sequence: Synthetic oligonucleotide
uggugugcguuuugauaggcaguagua

SEQ ID NO: 1268 - RNA, 27 nt, Artificial Sequence
  Description of Artificial Sequence: Synthetic oligonucleotide
gugguuggcguuuugauaggcaguagu

SEQ ID NO: 1269 - RNA, 27 nt, Artificial Sequence
  Description of Artificial Sequence: Synthetic oligonucleotide
uuguguugggcguuuugauaggcagua

SEQ ID NO: 1270 - RNA, 27 nt, Artificial Sequence
  Description of Artificial Sequence: Synthetic oligonucleotide
cugcauuuguggugggcguuuugauag

SEQ ID NO: 1271 - RNA, 27 nt, Artificial Sequence
  Description of Artificial Sequence: Synthetic oligonucleotide
acugcuuuuguggugggcguuuugaua

SEQ ID NO: 1272 - RNA, 27 nt, Artificial Sequence
  Description of Artificial Sequence: Synthetic oligonucleotide
cacuguauuuguggugggcguuuugau

SEQ ID NO: 1273 - RNA, 27 nt, Artificial Sequence
  Description of Artificial Sequence: Synthetic oligonucleotide
gcacuucauuuguggugggcguuuuga

SEQ ID NO: 1274 - RNA, 27 nt, Artificial Sequence
  Description of Artificial Sequence: Synthetic oligonucleotide
gugcauugcauuuguggugggcguuuu

SEQ ID NO: 1275 - RNA, 27 nt, Artificial Sequence
  Description of Artificial Sequence: Synthetic oligonucleotide
uuguguacugcauuuguggugggcguu

SEQ ID NO: 1276 - RNA, 27 nt, Artificial Sequence
  Description of Artificial Sequence: Synthetic oligonucleotide
cuuguucacugcauuuguggugggcgu

SEQ ID NO: 1277 - RNA, 27 nt, Artificial Sequence
  Description of Artificial Sequence: Synthetic oligonucleotide
ucugcucuugugcacugcauuuguggu

SEQ ID NO: 1278 - RNA, 27 nt, Artificial Sequence
  Description of Artificial Sequence: Synthetic oligonucleotide
cucuguacuugugcacugcauuugugg

SEQ ID NO: 1279 - RNA, 27 nt, Artificial Sequence
  Description of Artificial Sequence: Synthetic oligonucleotide
acucuucacuugugcacugcauuugug

SEQ ID NO: 1280 - RNA, 27 nt, Artificial Sequence
  Description of Artificial Sequence: Synthetic oligonucleotide
ucagguagcugguuauccacugggcgg

SEQ ID NO: 1281 - RNA, 27 nt, Artificial Sequence
  Description of Artificial Sequence: Synthetic oligonucleotide
uucaguaagcugguuauccacugggcg

SEQ ID NO: 1282 - RNA, 27 nt, Artificial Sequence
  Description of Artificial Sequence: Synthetic oligonucleotide
cuucaugaagcugguuauccacugggc

SEQ ID NO: 1283 - RNA, 27 nt, Artificial Sequence
  Description of Artificial Sequence: Synthetic oligonucleotide
acuucuggaagcugguuauccacuggg

SEQ ID NO: 1284 - RNA, 27 nt, Artificial Sequence
  Description of Artificial Sequence: Synthetic oligonucleotide
gacuuuaggaagcugguuauccacugg

SEQ ID NO: 1285 - RNA, 27 nt, Artificial Sequence
  Description of Artificial Sequence: Synthetic oligonucleotide
ugacuucaggaagcugguuauccacug

SEQ ID NO: 1286 - RNA, 27 nt, Artificial Sequence
  Description of Artificial Sequence: Synthetic oligonucleotide
gugacuucaggaagcugguuauccacu

SEQ ID NO: 1287 - RNA, 27 nt, Artificial Sequence
  Description of Artificial Sequence: Synthetic oligonucleotide
ugugauuucaggaagcugguuauccac

SEQ ID NO: 1288 - RNA, 27 nt, Artificial Sequence
  Description of Artificial Sequence: Synthetic oligonucleotide
cugugucuucaggaagcugguuaucca

SEQ ID NO: 1289 - RNA, 27 nt, Artificial Sequence
  Description of Artificial Sequence: Synthetic oligonucleotide
gcuguuacuucaggaagcugguuaucc

SEQ ID NO: 1290 - RNA, 27 nt, Artificial Sequence
  Description of Artificial Sequence: Synthetic oligonucleotide
ggcugugacuucaggaagcugguuauc

SEQ ID NO: 1291 - RNA, 27 nt, Artificial Sequence
  Description of Artificial Sequence: Synthetic oligonucleotide
gggcuuugacuucaggaagcugguuau

SEQ ID NO: 1292 - RNA, 27 nt, Artificial Sequence
  Description of Artificial Sequence: Synthetic oligonucleotide
agggcugugacuucaggaagcugguua

SEQ ID NO: 1293 - RNA, 27 nt, Artificial Sequence
  Description of Artificial Sequence: Synthetic oligonucleotide
uaggguugugacuucaggaagcugguu

SEQ ID NO: 1294 - RNA, 27 nt, Artificial Sequence
  Description of Artificial Sequence: Synthetic oligonucleotide
guaggucugugacuucaggaagcuggu

SEQ ID NO: 1295 - RNA, 27 nt, Artificial Sequence
  Description of Artificial Sequence: Synthetic oligonucleotide
gguagugcugugacuucaggaagcugg

SEQ ID NO: 1296 - RNA, 27 nt, Artificial Sequence
  Description of Artificial Sequence: Synthetic oligonucleotide
cgguauggcugugacuucaggaagcug

SEQ ID NO: 1297 - RNA, 27 nt, Artificial Sequence
  Description of Artificial Sequence: Synthetic oligonucleotide
ugagguucgaagugcaccaggcgguag

SEQ ID NO: 1298 - RNA, 27 nt, Artificial Sequence
  Description of Artificial Sequence: Synthetic oligonucleotide
ugugaugcucgaagugcaccaggcggu

SEQ ID NO: 1299 - RNA, 27 nt, Artificial Sequence
  Description of Artificial Sequence: Synthetic oligonucleotide
auguguggcucgaagugcaccaggcgg

SEQ ID NO: 1300 - RNA, 27 nt, Artificial Sequence
  Description of Artificial Sequence: Synthetic oligonucleotide
cauguuaggcucgaagugcaccaggcg

SEQ ID NO: 1301 - RNA, 27 nt, Artificial Sequence
  Description of Artificial Sequence: Synthetic oligonucleotide
gucgcuugugaggcucgaagugcacca

SEQ ID NO: 1302 - RNA, 27 nt, Artificial Sequence
  Description of Artificial Sequence: Synthetic oligonucleotide
ucgguugcaugugaggcucgaagugca

SEQ ID NO: 1303 - RNA, 27 nt, Artificial Sequence
  Description of Artificial Sequence: Synthetic oligonucleotide
gaugaugacgucucggucgcaugugag

SEQ ID NO: 1304 - RNA, 27 nt, Artificial Sequence
  Description of Artificial Sequence: Synthetic oligonucleotide
uugauuaggacgucucggucgcaugug

SEQ ID NO: 1305 - RNA, 27 nt, Artificial Sequence
  Description of Artificial Sequence: Synthetic oligonucleotide
uauuuuaugaggacgucucggucgcau

SEQ ID NO: 1306 - RNA, 27 nt, Artificial Sequence
  Description of Artificial Sequence: Synthetic oligonucleotide
cuauuugaugaggacgucucggucgca

SEQ ID NO: 1307 - RNA, 27 nt, Artificial Sequence
  Description of Artificial Sequence: Synthetic oligonucleotide
ugcuauuugaugaggacgucucggucg

SEQ ID NO: 1308 - RNA, 27 nt, Artificial Sequence
  Description of Artificial Sequence: Synthetic oligonucleotide
cugcuuuuugaugaggacgucucgguc

SEQ ID NO: 1309 - RNA, 27 nt, Artificial Sequence
  Description of Artificial Sequence: Synthetic oligonucleotide
ucugcuauuugaugaggacgucucggu

SEQ ID NO: 1310 - RNA, 27 nt, Artificial Sequence
  Description of Artificial Sequence: Synthetic oligonucleotide
gucuguuauuugaugaggacgucucgg

SEQ ID NO: 1311 - RNA, 27 nt, Artificial Sequence
  Description of Artificial Sequence: Synthetic oligonucleotide
agucuucuauuugaugaggacgucucg

SEQ ID NO: 1312 - RNA, 27 nt, Artificial Sequence
  Description of Artificial Sequence: Synthetic oligonucleotide
aagucugcuauuugaugaggacgucuc

SEQ ID NO: 1313 - RNA, 27 nt, Artificial Sequence
  Description of Artificial Sequence: Synthetic oligonucleotide
caaguuugcuauuugaugaggacgucu

SEQ ID NO: 1314 - RNA, 27 nt, Artificial Sequence
  Description of Artificial Sequence: Synthetic oligonucleotide
acaagucugcuauuugaugaggacguc

SEQ ID NO: 1315 - RNA, 27 nt, Artificial Sequence
  Description of Artificial Sequence: Synthetic oligonucleotide
aacaauucugcuauuugaugaggacgu

SEQ ID NO: 1316 - RNA, 27 nt, Artificial Sequence
  Description of Artificial Sequence: Synthetic oligonucleotide
gaacaugucugcuauuugaugaggacg

SEQ ID NO: 1317 - RNA, 27 nt, Artificial Sequence
  Description of Artificial Sequence: Synthetic oligonucleotide
ggaacuagucugcuauuugaugaggac

SEQ ID NO: 1318 - RNA, 27 nt, Artificial Sequence
  Description of Artificial Sequence: Synthetic oligonucleotide
cggaauaagucugcuauuugaugagga

SEQ ID NO: 1319 - RNA, 27 nt, Artificial Sequence
  Description of Artificial Sequence: Synthetic oligonucleotide
ucggaucaagucugcuauuugaugagg

SEQ ID NO: 1320 - RNA, 27 nt, Artificial Sequence
  Description of Artificial Sequence: Synthetic oligonucleotide
gucgguacaagucugcuauuugaugag

SEQ ID NO: 1321 - RNA, 27 nt, Artificial Sequence
  Description of Artificial Sequence: Synthetic oligonucleotide
ggucguaacaagucugcuauuugauga

SEQ ID NO: 1322 - RNA, 27 nt, Artificial Sequence
  Description of Artificial Sequence: Synthetic oligonucleotide
gggucugaacaagucugcuauuugaug

SEQ ID NO: 1323 - RNA, 27 nt, Artificial Sequence
  Description of Artificial Sequence: Synthetic oligonucleotide
uggguuggaacaagucugcuauuugau

SEQ ID NO: 1324 - RNA, 27 nt, Artificial Sequence
  Description of Artificial Sequence: Synthetic oligonucleotide
uugggucggaacaagucugcuauuuga

SEQ ID NO: 1325 - RNA, 27 nt, Artificial Sequence
  Description of Artificial Sequence: Synthetic oligonucleotide
cuugguucggaacaagucugcuauuug

SEQ ID NO: 1326 - RNA, 27 nt, Artificial Sequence
  Description of Artificial Sequence: Synthetic oligonucleotide
ccuugugucggaacaagucugcuauuu

SEQ ID NO: 1327 - RNA, 27 nt, Artificial Sequence
  Description of Artificial Sequence: Synthetic oligonucleotide
uccuuuggucggaacaagucugcuauu

SEQ ID NO: 1328 - RNA, 27 nt, Artificial Sequence
  Description of Artificial Sequence: Synthetic oligonucleotide
guccuugggucggaacaagucugcuau

SEQ ID NO: 1329 - RNA, 27 nt, Artificial Sequence
  Description of Artificial Sequence: Synthetic oligonucleotide
gguccuugggucggaacaagucugcua

SEQ ID NO: 1330 - RNA, 27 nt, Artificial Sequence
  Description of Artificial Sequence: Synthetic oligonucleotide
uggucuuugggucggaacaagucugcu

SEQ ID NO: 1331 - RNA, 27 nt, Artificial Sequence
  Description of Artificial Sequence: Synthetic oligonucleotide
cugguucuugggucggaacaagucugc

SEQ ID NO: 1332 - RNA, 27 nt, Artificial Sequence
  Description of Artificial Sequence: Synthetic oligonucleotide
ucugguccuugggucggaacaagucug

SEQ ID NO: 1333 - RNA, 27 nt, Artificial Sequence
  Description of Artificial Sequence: Synthetic oligonucleotide
aucuguuccuugggucggaacaagucu

SEQ ID NO: 1334 - RNA, 27 nt, Artificial Sequence
  Description of Artificial Sequence: Synthetic oligonucleotide
aaucuuguccuugggucggaacaaguc

SEQ ID NO: 1335 - RNA, 27 nt, Artificial Sequence
  Description of Artificial Sequence: Synthetic oligonucleotide
caaucugguccuugggucggaacaagu

SEQ ID NO: 1336 - RNA, 27 nt, Artificial Sequence
  Description of Artificial Sequence: Synthetic oligonucleotide
gcaauuugguccuugggucggaacaag

SEQ ID NO: 1337 - RNA, 27 nt, Artificial Sequence
  Description of Artificial Sequence: Synthetic oligonucleotide
agcaaucugguccuugggucggaacaa

SEQ ID NO: 1338 - RNA, 27 nt, Artificial Sequence
  Description of Artificial Sequence: Synthetic oligonucleotide
aagcauucugguccuugggucggaaca

SEQ ID NO: 1339 - RNA, 27 nt, Artificial Sequence
  Description of Artificial Sequence: Synthetic oligonucleotide
uaagcuaucugguccuugggucggaac

SEQ ID NO: 1340 - RNA, 27 nt, Artificial Sequence
  Description of Artificial Sequence: Synthetic oligonucleotide
guaaguaaucugguccuugggucggaa

SEQ ID NO: 1341 - RNA, 27 nt, Artificial Sequence
  Description of Artificial Sequence: Synthetic oligonucleotide
aguaaucaaucugguccuugggucgga

SEQ ID NO: 1342 - RNA, 27 nt, Artificial Sequence
  Description of Artificial Sequence: Synthetic oligonucleotide
gaguaugcaaucugguccuugggucgg

SEQ ID NO: 1343 - RNA, 27 nt, Artificial Sequence
  Description of Artificial Sequence: Synthetic oligonucleotide
ugaguuagcaaucugguccuugggucg

SEQ ID NO: 1344 - RNA, 27 nt, Artificial Sequence
  Description of Artificial Sequence: Synthetic oligonucleotide
cugaguaagcaaucugguccuuggguc

SEQ ID NO: 1345 - RNA, 27 nt, Artificial Sequence
  Description of Artificial Sequence: Synthetic oligonucleotide
ucugauuaagcaaucugguccuugggu

SEQ ID NO: 1346 - RNA, 27 nt, Artificial Sequence
  Description of Artificial Sequence: Synthetic oligonucleotide
gucuguguaagcaaucugguccuuggg

SEQ ID NO: 1347 - RNA, 27 nt, Artificial Sequence
  Description of Artificial Sequence: Synthetic oligonucleotide
ugucuuaguaagcaaucugguccuugg

SEQ ID NO: 1348 - RNA, 27 nt, Artificial Sequence
  Description of Artificial Sequence: Synthetic oligonucleotide
gugucugaguaagcaaucugguccuug

SEQ ID NO: 1349 - RNA, 27 nt, Artificial Sequence
  Description of Artificial Sequence: Synthetic oligonucleotide
gguguuugaguaagcaaucugguccuu

SEQ ID NO: 1350 - RNA, 27 nt, Artificial Sequence
  Description of Artificial Sequence: Synthetic oligonucleotide
uggugucugaguaagcaaucugguccu

SEQ ID NO: 1351 - RNA, 27 nt, Artificial Sequence
  Description of Artificial Sequence: Synthetic oligonucleotide
cugguuucugaguaagcaaucuggucc

SEQ ID NO: 1352 - RNA, 27 nt, Artificial Sequence
  Description of Artificial Sequence: Synthetic oligonucleotide
gcuggugucugaguaagcaaucugguc

SEQ ID NO: 1353 - RNA, 27 nt, Artificial Sequence
  Description of Artificial Sequence: Synthetic oligonucleotide
ggcuguugucugaguaagcaaucuggu

SEQ ID NO: 1354 - RNA, 27 nt, Artificial Sequence
  Description of Artificial Sequence: Synthetic oligonucleotide
gggcuugugucugaguaagcaaucugg

SEQ ID NO: 1355 - RNA, 27 nt, Artificial Sequence
  Description of Artificial Sequence: Synthetic oligonucleotide
ugggcuggugucugaguaagcaaucug

SEQ ID NO: 1356 - RNA, 27 nt, Artificial Sequence
  Description of Artificial Sequence: Synthetic oligonucleotide
auggguuggugucugaguaagcaaucu

SEQ ID NO: 1357 - RNA, 27 nt, Artificial Sequence
  Description of Artificial Sequence: Synthetic oligonucleotide
aauggucuggugucugaguaagcaauc

SEQ ID NO: 1358 - RNA, 27 nt, Artificial Sequence
  Description of Artificial Sequence: Synthetic oligonucleotide
gaaugugcuggugucugaguaagcaau

SEQ ID NO: 1359 - RNA, 27 nt, Artificial Sequence
  Description of Artificial Sequence: Synthetic oligonucleotide
agaauuggcuggugucugaguaagcaa

SEQ ID NO: 1360 - RNA, 27 nt, Artificial Sequence
  Description of Artificial Sequence: Synthetic oligonucleotide
aagaaugggcuggugucugaguaagca

SEQ ID NO: 1361 - RNA, 27 nt, Artificial Sequence
  Description of Artificial Sequence: Synthetic oligonucleotide
caagauugggcuggugucugaguaagc

SEQ ID NO: 1362 - RNA, 27 nt, Artificial Sequence
  Description of Artificial Sequence: Synthetic oligonucleotide
ucaaguaugggcuggugucugaguaag

SEQ ID NO: 1363 - RNA, 27 nt, Artificial Sequence
  Description of Artificial Sequence: Synthetic oligonucleotide
aucaauaaugggcuggugucugaguaa

SEQ ID NO: 1364 - RNA, 27 nt, Artificial Sequence
  Description of Artificial Sequence: Synthetic oligonucleotide
gaucaugaaugggcuggugucugagua

SEQ ID NO: 1365 - RNA, 27 nt, Artificial Sequence
  Description of Artificial Sequence: Synthetic oligonucleotide
ggaucuagaaugggcuggugucugagu

SEQ ID NO: 1366 - RNA, 27 nt, Artificial Sequence
  Description of Artificial Sequence: Synthetic oligonucleotide
aggauuaagaaugggcuggugucugag

SEQ ID NO: 1367 - RNA, 27 nt, Artificial Sequence
  Description of Artificial Sequence: Synthetic oligonucleotide
aaggaucaagaaugggcuggugucuga

SEQ ID NO: 1368 - RNA, 27 nt, Artificial Sequence
  Description of Artificial Sequence: Synthetic oligonucleotide
aaagguucaagaaugggcuggugucug

SEQ ID NO: 1369 - RNA, 27 nt, Artificial Sequence
  Description of Artificial Sequence: Synthetic oligonucleotide
gaaaguaucaagaaugggcuggugucu

SEQ ID NO: 1370 - RNA, 27 nt, Artificial Sequence
  Description of Artificial Sequence: Synthetic oligonucleotide
agaaaugaucaagaaugggcugguguc

SEQ ID NO: 1371 - RNA, 27 nt, Artificial Sequence
  Description of Artificial Sequence: Synthetic oligonucleotide
cagaauggaucaagaaugggcuggugu

SEQ ID NO: 1372 - RNA, 27 nt, Artificial Sequence
  Description of Artificial Sequence: Synthetic oligonucleotide
ucagauaggaucaagaaugggcuggug

SEQ ID NO: 1373 - RNA, 27 nt, Artificial Sequence
  Description of Artificial Sequence: Synthetic oligonucleotide
cucaguaaggaucaagaaugggcuggu

SEQ ID NO: 1374 - RNA, 27 nt, Artificial Sequence
  Description of Artificial Sequence: Synthetic oligonucleotide
ccucauaaaggaucaagaaugggcugg

SEQ ID NO: 1375 - RNA, 27 nt, Artificial Sequence
  Description of Artificial Sequence: Synthetic oligonucleotide
gacgcuucagaaaggaucaagaauggg

SEQ ID NO: 1376 - RNA, 27 nt, Artificial Sequence
  Description of Artificial Sequence: Synthetic oligonucleotide
cgacgucucagaaaggaucaagaaugg

SEQ ID NO: 1377 - RNA, 27 nt, Artificial Sequence
  Description of Artificial Sequence: Synthetic oligonucleotide
uucuuuucuagccuggaguugagaucc

SEQ ID NO: 1378 - RNA, 27 nt, Artificial Sequence
  Description of Artificial Sequence: Synthetic oligonucleotide
cuuucuucucuagccuggaguugagau

SEQ ID NO: 1379 - RNA, 27 nt, Artificial Sequence
  Description of Artificial Sequence: Synthetic oligonucleotide
aacuuucuucucuagccuggaguugag

SEQ ID NO: 1380 - RNA, 27 nt, Artificial Sequence
  Description of Artificial Sequence: Synthetic oligonucleotide
uaacuuucuucucuagccuggaguuga

SEQ ID NO: 1381 - RNA, 27 nt, Artificial Sequence
  Description of Artificial Sequence: Synthetic oligonucleotide
uuaacuuucuucucuagccuggaguug

SEQ ID NO: 1382 - RNA, 27 nt, Artificial Sequence
  Description of Artificial Sequence: Synthetic oligonucleotide
uuuaauuuucuucucuagccuggaguu

SEQ ID NO: 1383 - RNA, 27 nt, Artificial Sequence
  Description of Artificial Sequence: Synthetic oligonucleotide
gcuuuuacuuucuucucuagccuggag

SEQ ID NO: 1384 - RNA, 27 nt, Artificial Sequence
  Description of Artificial Sequence: Synthetic oligonucleotide
ugcuuuaacuuucuucucuagccugga

SEQ ID NO: 1385 - RNA, 27 nt, Artificial Sequence
  Description of Artificial Sequence: Synthetic oligonucleotide
uugcuuuaacuuucuucucuagccugg

SEQ ID NO: 1386 - RNA, 27 nt, Artificial Sequence
  Description of Artificial Sequence: Synthetic oligonucleotide
guugcuuuaacuuucuucucuagccug

SEQ ID NO: 1387 - RNA, 27 nt, Artificial Sequence
  Description of Artificial Sequence: Synthetic oligonucleotide
gguuguuuuaacuuucuucucuagccu

SEQ ID NO: 1388 - RNA, 27 nt, Artificial Sequence
  Description of Artificial Sequence: Synthetic oligonucleotide
ugguuucuuuaacuuucuucucuagcc

SEQ ID NO: 1389 - RNA, 27 nt, Artificial Sequence
  Description of Artificial Sequence: Synthetic oligonucleotide
uugguugcuuuaacuuucuucucuagc

SEQ ID NO: 1390 - RNA, 27 nt, Artificial Sequence
  Description of Artificial Sequence: Synthetic oligonucleotide
guugguugcuuuaacuuucuucucuag

SEQ ID NO: 1391 - RNA, 27 nt, Artificial Sequence
  Description of Artificial Sequence: Synthetic oligonucleotide
aguuguuugcuuuaacuuucuucucua

SEQ ID NO: 1392 - RNA, 27 nt, Artificial Sequence
  Description of Artificial Sequence: Synthetic oligonucleotide
aaguuuguugcuuuaacuuucuucucu

SEQ ID NO: 1393 - RNA, 27 nt, Artificial Sequence
  Description of Artificial Sequence: Synthetic oligonucleotide
gaaguugguugcuuuaacuuucuucuc

SEQ ID NO: 1394 - RNA, 27 nt, Artificial Sequence
  Description of Artificial Sequence: Synthetic oligonucleotide
ugaaguugguugcuuuaacuuucuucu

SEQ ID NO: 1395 - RNA, 27 nt, Artificial Sequence
  Description of Artificial Sequence: Synthetic oligonucleotide
cugaauuugguugcuuuaacuuucuuc

SEQ ID NO: 1396 - RNA, 27 nt, Artificial Sequence
  Description of Artificial Sequence: Synthetic oligonucleotide
ccugauguugguugcuuuaacuuucuu

SEQ ID NO: 1397 - RNA, 27 nt, Artificial Sequence
  Description of Artificial Sequence: Synthetic oligonucleotide
gccuguaguugguugcuuuaacuuucu

SEQ ID NO: 1398 - RNA, 27 nt, Artificial Sequence
  Description of Artificial Sequence: Synthetic oligonucleotide
ggccuuaaguugguugcuuuaacuuuc

SEQ ID NO: 1399 - RNA, 27 nt, Artificial Sequence
  Description of Artificial Sequence: Synthetic oligonucleotide
ugggcuugaaguugguugcuuuaacuu

SEQ ID NO: 1400 - RNA, 27 nt, Artificial Sequence
  Description of Artificial Sequence: Synthetic oligonucleotide
uugggucugaaguugguugcuuuaacu

SEQ ID NO: 1401 - RNA, 27 nt, Artificial Sequence
  Description of Artificial Sequence: Synthetic oligonucleotide
auugguccugaaguugguugcuuuaac

SEQ ID NO: 1402 - RNA, 27 nt, Artificial Sequence
  Description of Artificial Sequence: Synthetic oligonucleotide
uauugugccugaaguugguugcuuuaa

SEQ ID NO: 1403 - RNA, 27 nt, Artificial Sequence
  Description of Artificial Sequence: Synthetic oligonucleotide
auauuuggccugaaguugguugcuuua

SEQ ID NO: 1404 - RNA, 27 nt, Artificial Sequence
  Description of Artificial Sequence: Synthetic oligonucleotide
aauauugggccugaaguugguugcuuu

SEQ ID NO: 1405 - RNA, 27 nt, Artificial Sequence
  Description of Artificial Sequence: Synthetic oligonucleotide
caauauugggccugaaguugguugcuu

SEQ ID NO: 1406 - RNA, 27 nt, Artificial Sequence
  Description of Artificial Sequence: Synthetic oligonucleotide
uacaauauugggccugaaguugguugc

SEQ ID NO: 1407 - RNA, 27 nt, Artificial Sequence
  Description of Artificial Sequence: Synthetic oligonucleotide
uuacauuauugggccugaaguugguug

SEQ ID NO: 1408 - RNA, 27 nt, Artificial Sequence
  Description of Artificial Sequence: Synthetic oligonucleotide
auuacuauauugggccugaaguugguu

SEQ ID NO: 1409 - RNA, 27 nt, Artificial Sequence
  Description of Artificial Sequence: Synthetic oligonucleotide
aauuauaauauugggccugaaguuggu

SEQ ID NO: 1410 - RNA, 27 nt, Artificial Sequence
  Description of Artificial Sequence: Synthetic oligonucleotide
aaauuucaauauugggccugaaguugg

SEQ ID NO: 1411 - RNA, 27 nt, Artificial Sequence
  Description of Artificial Sequence: Synthetic oligonucleotide
gaaauuacaauauugggccugaaguug

SEQ ID NO: 1412 - RNA, 27 nt, Artificial Sequence
  Description of Artificial Sequence: Synthetic oligonucleotide
ugaaauuacaauauugggccugaaguu

SEQ ID NO: 1413 - RNA, 27 nt, Artificial Sequence
  Description of Artificial Sequence: Synthetic oligonucleotide
cugaauuuacaauauugggccugaagu

SEQ ID NO: 1414 - RNA, 27 nt, Artificial Sequence
  Description of Artificial Sequence: Synthetic oligonucleotide
ccugauauuacaauauugggccugaag

SEQ ID NO: 1415 - RNA, 27 nt, Artificial Sequence
  Description of Artificial Sequence: Synthetic oligonucleotide
uccuguaauuacaauauugggccugaa

SEQ ID NO: 1416 - RNA, 27 nt, Artificial Sequence
  Description of Artificial Sequence: Synthetic oligonucleotide
auccuuaaauuacaauauugggccuga

SEQ ID NO: 1417 - RNA, 27 nt, Artificial Sequence
  Description of Artificial Sequence: Synthetic oligonucleotide
cauccugaaauuacaauauugggccug

SEQ ID NO: 1418 - RNA, 27 nt, Artificial Sequence
  Description of Artificial Sequence: Synthetic oligonucleotide
gcaucuugaaauuacaauauugggccu

SEQ ID NO: 1419 - RNA, 27 nt, Artificial Sequence
  Description of Artificial Sequence: Synthetic oligonucleotide
cgcauucugaaauuacaauauugggcc

SEQ ID NO: 1420 - RNA, 27 nt, Artificial Sequence
  Description of Artificial Sequence: Synthetic oligonucleotide
ucgcauccugaaauuacaauauugggc

SEQ ID NO: 1421 - RNA, 27 nt, Artificial Sequence
  Description of Artificial Sequence: Synthetic oligonucleotide
aucgcuuccugaaauuacaauauuggg

SEQ ID NO: 1422 - RNA, 27 nt, Artificial Sequence
  Description of Artificial Sequence: Synthetic oligonucleotide
caucguauccugaaauuacaauauugg

SEQ ID NO: 1423 - RNA, 27 nt, Artificial Sequence
  Description of Artificial Sequence: Synthetic oligonucleotide
acaucucauccugaaauuacaauauug

SEQ ID NO: 1424 - RNA, 27 nt, Artificial Sequence
  Description of Artificial Sequence: Synthetic oligonucleotide
gacauugcauccugaaauuacaauauu

SEQ ID NO: 1425 - RNA, 27 nt, Artificial Sequence
  Description of Artificial Sequence: Synthetic oligonucleotide
agacaucgcauccugaaauuacaauau

SEQ ID NO: 1426 - RNA, 27 nt, Artificial Sequence
  Description of Artificial Sequence: Synthetic oligonucleotide
uagacuucgcauccugaaauuacaaua

SEQ ID NO: 1427 - RNA, 27 nt, Artificial Sequence
  Description of Artificial Sequence: Synthetic oligonucleotide
auagauaucgcauccugaaauuacaau

SEQ ID NO: 1428 - RNA, 27 nt, Artificial Sequence
  Description of Artificial Sequence: Synthetic oligonucleotide
cauagucaucgcauccugaaauuacaa

SEQ ID NO: 1429 - RNA, 27 nt, Artificial Sequence
  Description of Artificial Sequence: Synthetic oligonucleotide
gcauauacaucgcauccugaaauuaca

SEQ ID NO: 1430 - RNA, 27 nt, Artificial Sequence
  Description of Artificial Sequence: Synthetic oligonucleotide
ugcauugacaucgcauccugaaauuac

SEQ ID NO: 1431 - RNA, 27 nt, Artificial Sequence
  Description of Artificial Sequence: Synthetic oligonucleotide
cugcauagacaucgcauccugaaauua

SEQ ID NO: 1432 - RNA, 27 nt, Artificial Sequence
  Description of Artificial Sequence: Synthetic oligonucleotide
ucugcuuagacaucgcauccugaaauu

SEQ ID NO: 1433 - RNA, 27 nt, Artificial Sequence
  Description of Artificial Sequence: Synthetic oligonucleotide
cucuguauagacaucgcauccugaaau

SEQ ID NO: 1434 - RNA, 27 nt, Artificial Sequence
  Description of Artificial Sequence: Synthetic oligonucleotide
ccucuucauagacaucgcauccugaaa

SEQ ID NO: 1435 - RNA, 27 nt, Artificial Sequence
  Description of Artificial Sequence: Synthetic oligonucleotide
uccucugcauagacaucgcauccugaa

SEQ ID NO: 1436 - RNA, 27 nt, Artificial Sequence
  Description of Artificial Sequence: Synthetic oligonucleotide
auccuuugcauagacaucgcauccuga

SEQ ID NO: 1437 - RNA, 27 nt, Artificial Sequence
  Description of Artificial Sequence: Synthetic oligonucleotide
aauccucugcauagacaucgcauccug

SEQ ID NO: 1438 - RNA, 27 nt, Artificial Sequence
  Description of Artificial Sequence: Synthetic oligonucleotide
gaaucuucugcauagacaucgcauccu

SEQ ID NO: 1439 - RNA, 27 nt, Artificial Sequence
  Description of Artificial Sequence: Synthetic oligonucleotide
agaauucucugcauagacaucgcaucc

SEQ ID NO: 1440 - RNA, 27 nt, Artificial Sequence
  Description of Artificial Sequence: Synthetic oligonucleotide
guguuuccucugcauagacaucgcauc

SEQ ID NO: 1441 - RNA, 27 nt, Artificial Sequence
  Description of Artificial Sequence: Synthetic oligonucleotide
ugugguuaaaaugcaucuggaacaagc

SEQ ID NO: 1442 - RNA, 27 nt, Artificial Sequence
  Description of Artificial Sequence: Synthetic oligonucleotide
cuggcuauaacucuucaguguuuccag

SEQ ID NO: 1443 - RNA, 27 nt, Artificial Sequence
  Description of Artificial Sequence: Synthetic oligonucleotide
acuggugauaacucuucaguguuucca

SEQ ID NO: 1444 - RNA, 27 nt, Artificial Sequence
  Description of Artificial Sequence: Synthetic oligonucleotide
ucacauuggcgauaacucuucaguguu

SEQ ID NO: 1445 - RNA, 27 nt, Artificial Sequence
  Description of Artificial Sequence: Synthetic oligonucleotide
uauaauuuucguucugaagggucacac

SEQ ID NO: 1446 - RNA, 27 nt, Artificial Sequence
  Description of Artificial Sequence: Synthetic oligonucleotide
uccauuuaacuuucguucugaaggguc

SEQ ID NO: 1447 - RNA, 27 nt, Artificial Sequence
  Description of Artificial Sequence: Synthetic oligonucleotide
uuccauauaacuuucguucugaagggu

SEQ ID NO: 1448 - RNA, 27 nt, Artificial Sequence
  Description of Artificial Sequence: Synthetic oligonucleotide
auuuuucauauaacuuucguucugaag

SEQ ID NO: 1449 - RNA, 27 nt, Artificial Sequence
  Description of Artificial Sequence: Synthetic oligonucleotide
gauuuuccauauaacuuucguucugaa

SEQ ID NO: 1450 - RNA, 27 nt, Artificial Sequence
  Description of Artificial Sequence: Synthetic oligonucleotide
ugauuuuccauauaacuuucguucuga

SEQ ID NO: 1451 - RNA, 27 nt, Artificial Sequence
  Description of Artificial Sequence: Synthetic oligonucleotide
gugauuuuccauauaacuuucguucug

SEQ ID NO: 1452 - RNA, 27 nt, Artificial Sequence
  Description of Artificial Sequence: Synthetic oligonucleotide
ggugauuuuccauauaacuuucguucu

SEQ ID NO: 1453 - RNA, 27 nt, Artificial Sequence
  Description of Artificial Sequence: Synthetic oligonucleotide
gugguuauuuuccauauaacuuucguu

SEQ ID NO: 1454 - RNA, 27 nt, Artificial Sequence
  Description of Artificial Sequence: Synthetic oligonucleotide
aguggugauuuuccauauaacuuucgu

SEQ ID NO: 1455 - RNA, 27 nt, Artificial Sequence
  Description of Artificial Sequence: Synthetic oligonucleotide
gaguguugauuuuccauauaacuuucg

SEQ ID NO: 1456 - RNA, 27 nt, Artificial Sequence
  Description of Artificial Sequence: Synthetic oligonucleotide
uguugucauuuuugagaacauuuuuaa

SEQ ID NO: 1457 - RNA, 27 nt, Artificial Sequence
  Description of Artificial Sequence: Synthetic oligonucleotide
uucaauuguugucauuuuugagaacau

SEQ ID NO: 1458 - RNA, 27 nt, Artificial Sequence
  Description of Artificial Sequence: Synthetic oligonucleotide
caugcuucaaguguugucauuuuugag

SEQ ID NO: 1459 - RNA, 27 nt, Artificial Sequence
  Description of Artificial Sequence: Synthetic oligonucleotide
aacacuaugcuucaaguguugucauuu

SEQ ID NO: 1460 - RNA, 27 nt, Artificial Sequence
  Description of Artificial Sequence: Synthetic oligonucleotide
ugaaauaccaugcuucaaguguuguca

SEQ ID NO: 1461 - RNA, 27 nt, Artificial Sequence
  Description of Artificial Sequence: Synthetic oligonucleotide
cugaaucaccaugcuucaaguguuguc

SEQ ID NO: 1462 - RNA, 27 nt, Artificial Sequence
  Description of Artificial Sequence: Synthetic oligonucleotide
ucugauacaccaugcuucaaguguugu

SEQ ID NO: 1463 - RNA, 27 nt, Artificial Sequence
  Description of Artificial Sequence: Synthetic oligonucleotide
uucuguaacaccaugcuucaaguguug

SEQ ID NO: 1464 - RNA, 27 nt, Artificial Sequence
  Description of Artificial Sequence: Synthetic oligonucleotide
guucuuaaacaccaugcuucaaguguu

SEQ ID NO: 1465 - RNA, 27 nt, Artificial Sequence
  Description of Artificial Sequence: Synthetic oligonucleotide
caguuuugaaacaccaugcuucaagug

SEQ ID NO: 1466 - RNA, 27 nt, Artificial Sequence
  Description of Artificial Sequence: Synthetic oligonucleotide
ucaguucugaaacaccaugcuucaagu

SEQ ID NO: 1467 - RNA, 27 nt, Artificial Sequence
  Description of Artificial Sequence: Synthetic oligonucleotide
cucaguucugaaacaccaugcuucaag

SEQ ID NO: 1468 - RNA, 27 nt, Artificial Sequence
  Description of Artificial Sequence: Synthetic oligonucleotide
ucucauuucugaaacaccaugcuucaa

SEQ ID NO: 1469 - RNA, 27 nt, Artificial Sequence
  Description of Artificial Sequence: Synthetic oligonucleotide
gagguuucaguucugaaacaccaugcu

SEQ ID NO: 1470 - RNA, 27 nt, Artificial Sequence
  Description of Artificial Sequence: Synthetic oligonucleotide
auguauaggucucaguucugaaacacc

SEQ ID NO: 1471 - RNA, 27 nt, Artificial Sequence
  Description of Artificial Sequence: Synthetic oligonucleotide
aaaauuacaaauuuaaagaaaauguag

SEQ ID NO: 1472 - RNA, 27 nt, Artificial Sequence
  Description of Artificial Sequence: Synthetic oligonucleotide
ugaaauucacaaauuuaaagaaaaugu

SEQ ID NO: 1473 - RNA, 27 nt, Artificial Sequence
  Description of Artificial Sequence: Synthetic oligonucleotide
aaaauuugaaaaucacaaauuuaaaga

SEQ ID NO: 1474 - RNA, 27 nt, Artificial Sequence
  Description of Artificial Sequence: Synthetic oligonucleotide
acgaauaaugugaaaaucacaaauuua

SEQ ID NO: 1475 - RNA, 27 nt, Artificial Sequence
  Description of Artificial Sequence: Synthetic oligonucleotide
agacguaaaaugugaaaaucacaaauu

SEQ ID NO: 1476 - RNA, 27 nt, Artificial Sequence
  Description of Artificial Sequence: Synthetic oligonucleotide
agaacuauuccauaaucaguuaaacgg

SEQ ID NO: 1477 - RNA, 27 nt, Artificial Sequence
  Description of Artificial Sequence: Synthetic oligonucleotide
aagaauuauuccauaaucaguuaaacg

SEQ ID NO: 1478 - RNA, 27 nt, Artificial Sequence
  Description of Artificial Sequence: Synthetic oligonucleotide
gaaaguacuauuccauaaucaguuaaa

SEQ ID NO: 1479 - RNA, 27 nt, Artificial Sequence
  Description of Artificial Sequence: Synthetic oligonucleotide
agaaauaacuauuccauaaucaguuaa

SEQ ID NO: 1480 - RNA, 27 nt, Artificial Sequence
  Description of Artificial Sequence: Synthetic oligonucleotide
gagaaugaacuauuccauaaucaguua

SEQ ID NO: 1481 - RNA, 27 nt, Artificial Sequence
  Description of Artificial Sequence: Synthetic oligonucleotide
ggagauagaacuauuccauaaucaguu

SEQ ID NO: 1482 - RNA, 27 nt, Artificial Sequence
  Description of Artificial Sequence: Synthetic oligonucleotide
cagauuuauggaaaauuaauaucugca

SEQ ID NO: 1483 - RNA, 27 nt, Artificial Sequence
  Description of Artificial Sequence: Synthetic oligonucleotide
uccaguucuauggaaaauuaauaucug

SEQ ID NO: 1484 - RNA, 27 nt, Artificial Sequence
  Description of Artificial Sequence: Synthetic oligonucleotide
aggaauuccaaugcugucugagaagca

SEQ ID NO: 1485 - RNA, 27 nt, Artificial Sequence
  Description of Artificial Sequence: Synthetic oligonucleotide
uuuaguaaauccaaugcugucugagaa

SEQ ID NO: 1486 - RNA, 27 nt, Artificial Sequence
  Description of Artificial Sequence: Synthetic oligonucleotide
cuuuaugaaauccaaugcugucugaga

SEQ ID NO: 1487 - RNA, 27 nt, Artificial Sequence
  Description of Artificial Sequence: Synthetic oligonucleotide
ucugauaucacugaaucacuuuucuuc

SEQ ID NO: 1488 - RNA, 27 nt, Artificial Sequence
  Description of Artificial Sequence: Synthetic oligonucleotide
ucuauuugaaaucacugaaucacuuuu

SEQ ID NO: 1489 - RNA, 27 nt, Artificial Sequence
  Description of Artificial Sequence: Synthetic oligonucleotide
uuuaaucaacugacauaugcuuuccuu

SEQ ID NO: 1490 - RNA, 27 nt, Artificial Sequence
  Description of Artificial Sequence: Synthetic oligonucleotide
uuuuauacaacugacauaugcuuuccu

SEQ ID NO: 1491 - RNA, 27 nt, Artificial Sequence
  Description of Artificial Sequence: Synthetic oligonucleotide
uauuguguuuuaaacaacugacauaug

SEQ ID NO: 1492 - RNA, 27 nt, Artificial Sequence
  Description of Artificial Sequence: Synthetic oligonucleotide
auauuugguuuuaaacaacugacauau

SEQ ID NO: 1493 - RNA, 27 nt, Artificial Sequence
  Description of Artificial Sequence: Synthetic oligonucleotide
gauauuggguuuuaaacaacugacaua

SEQ ID NO: 1494 - RNA, 27 nt, Artificial Sequence
  Description of Artificial Sequence: Synthetic oligonucleotide
agauauuggguuuuaaacaacugacau

SEQ ID NO: 1495 - RNA, 27 nt, Artificial Sequence
  Description of Artificial Sequence: Synthetic oligonucleotide
aauaguuauuggguuuuaaacaacuga

SEQ ID NO: 1496 - RNA, 27 nt, Artificial Sequence
  Description of Artificial Sequence: Synthetic oligonucleotide
aaauauauauuggguuuuaaacaacug

SEQ ID NO: 1497 - RNA, 27 nt, Artificial Sequence
  Description of Artificial Sequence: Synthetic oligonucleotide
aaaauugauauuggguuuuaaacaacu

SEQ ID NO: 1498 - RNA, 27 nt, Artificial Sequence
  Description of Artificial Sequence: Synthetic oligonucleotide
aaaaauagauauuggguuuuaaacaac

SEQ ID NO: 1499 - RNA, 27 nt, Artificial Sequence
  Description of Artificial Sequence: Synthetic oligonucleotide
aaaaauuagauauuggguuuuaaacaa

SEQ ID NO: 1500 - RNA, 27 nt, Artificial Sequence
  Description of Artificial Sequence: Synthetic oligonucleotide
uggcauuaaaaaauauacuucaucaga

SEQ ID NO: 1501 - RNA, 27 nt, Artificial Sequence
  Description of Artificial Sequence: Synthetic oligonucleotide
auggcuauaaaaaauauacuucaucag

SEQ ID NO: 1502 - RNA, 27 nt, Artificial Sequence
  Description of Artificial Sequence: Synthetic oligonucleotide
aaugguaauaaaaaauauacuucauca

SEQ ID NO: 1503 - RNA, 27 nt, Artificial Sequence
  Description of Artificial Sequence: Synthetic oligonucleotide
aaaauugcaauaaaaaauauacuucau

SEQ ID NO: 1504 - RNA, 27 nt, Artificial Sequence
  Description of Artificial Sequence: Synthetic oligonucleotide
acaaauuggcaauaaaaaauauacuuc

SEQ ID NO: 1505 - RNA, 27 nt, Artificial Sequence
  Description of Artificial Sequence: Synthetic oligonucleotide
uauaaucaaaggacaaaauggcaauaa

SEQ ID NO: 1506 - RNA, 27 nt, Artificial Sequence
  Description of Artificial Sequence: Synthetic oligonucleotide
aauauuaucaaaggacaaaauggcaau

SEQ ID NO: 1507 - RNA, 27 nt, Artificial Sequence
  Description of Artificial Sequence: Synthetic oligonucleotide
cauuuuucaaguuuagucaacuuccca

SEQ ID NO: 1508 - RNA, 27 nt, Artificial Sequence
  Description of Artificial Sequence: Synthetic oligonucleotide
aacauuuuucaaguuuagucaacuucc

SEQ ID NO: 1509 - RNA, 27 nt, Artificial Sequence
  Description of Artificial Sequence: Synthetic oligonucleotide
aaaacuuuuuucaaguuuagucaacuu

SEQ ID NO: 1510 - RNA, 27 nt, Artificial Sequence
  Description of Artificial Sequence: Synthetic oligonucleotide
aaaaauauuuuucaaguuuagucaacu

SEQ ID NO: 1511 - RNA, 27 nt, Artificial Sequence
  Description of Artificial Sequence: Synthetic oligonucleotide
uuaaauacauuuuucaaguuuagucaa

SEQ ID NO: 1512 - RNA, 27 nt, Artificial Sequence
  Description of Artificial Sequence: Synthetic oligonucleotide
uuuaauaacauuuuucaaguuuaguca

SEQ ID NO: 1513 - RNA, 27 nt, Artificial Sequence
  Description of Artificial Sequence: Synthetic oligonucleotide
uuuuauaaacauuuuucaaguuuaguc

SEQ ID NO: 1514 - RNA, 27 nt, Artificial Sequence
  Description of Artificial Sequence: Synthetic oligonucleotide
cacaguuuuaaaaacauuuuucaaguu

SEQ ID NO: 1515 - RNA, 27 nt, Artificial Sequence
  Description of Artificial Sequence: Synthetic oligonucleotide
ucacauuuuuaaaaacauuuuucaagu

SEQ ID NO: 1516 - RNA, 27 nt, Artificial Sequence
  Description of Artificial Sequence: Synthetic oligonucleotide
auucauaguuuuaaaaacauuuuucaa

SEQ ID NO: 1517 - RNA, 27 nt, Artificial Sequence
  Description of Artificial Sequence: Synthetic oligonucleotide
uauucucaguuuuaaaaacauuuuuca

SEQ ID NO: 1518 - RNA, 27 nt, Artificial Sequence
  Description of Artificial Sequence: Synthetic oligonucleotide
uuauuuacaguuuuaaaaacauuuuuc

SEQ ID NO: 1519 - RNA, 27 nt, Artificial Sequence
  Description of Artificial Sequence: Synthetic oligonucleotide
uuuauucacaguuuuaaaaacauuuuu

SEQ ID NO: 1520 - RNA, 27 nt, Artificial Sequence
  Description of Artificial Sequence: Synthetic oligonucleotide
auuuauucacaguuuuaaaaacauuuu

SEQ ID NO: 1521 - RNA, 27 nt, Artificial Sequence
  Description of Artificial Sequence: Synthetic oligonucleotide
uccauuuauucacaguuuuaaaaacau

SEQ ID NO: 1522 - RNA, 27 nt, Artificial Sequence
  Description of Artificial Sequence: Synthetic oligonucleotide
uuccauuuauucacaguuuuaaaaaca

SEQ ID NO: 1523 - RNA, 27 nt, Artificial Sequence
  Description of Artificial Sequence: Synthetic oligonucleotide
uagcuuccauuuauucacaguuuuaaa

SEQ ID NO: 1524 - RNA, 27 nt, Artificial Sequence
  Description of Artificial Sequence: Synthetic oligonucleotide
guagcuuccauuuauucacaguuuuaa

SEQ ID NO: 1525 - RNA, 27 nt, Artificial Sequence
  Description of Artificial Sequence: Synthetic oligonucleotide
aguaguuuccauuuauucacaguuuua

SEQ ID NO: 1526 - RNA, 27 nt, Artificial Sequence
  Description of Artificial Sequence: Synthetic oligonucleotide
aaguaucuuccauuuauucacaguuuu

SEQ ID NO: 1527 - RNA, 27 nt, Artificial Sequence
  Description of Artificial Sequence: Synthetic oligonucleotide
caaaguagcuuccauuuauucacaguu

SEQ ID NO: 1528 - RNA, 27 nt, Artificial Sequence
  Description of Artificial Sequence: Synthetic oligonucleotide
ucaaauuagcuuccauuuauucacagu

SEQ ID NO: 1529 - RNA, 27 nt, Artificial Sequence
  Description of Artificial Sequence: Synthetic oligonucleotide
gucaauguagcuuccauuuauucacag

SEQ ID NO: 1530 - RNA, 27 nt, Artificial Sequence
  Description of Artificial Sequence: Synthetic oligonucleotide
agucauaguagcuuccauuuauucaca

SEQ ID NO: 1531 - RNA, 27 nt, Artificial Sequence
  Description of Artificial Sequence: Synthetic oligonucleotide
uagucuaaguagcuuccauuuauucac

SEQ ID NO: 1532 - RNA, 27 nt, Artificial Sequence
  Description of Artificial Sequence: Synthetic oligonucleotide
cuaguuaaaguagcuuccauuuauuca

SEQ ID NO: 1533 - RNA, 27 nt, Artificial Sequence
  Description of Artificial Sequence: Synthetic oligonucleotide
aacuauucaaaguagcuuccauuuauu

SEQ ID NO: 1534 - RNA, 27 nt, Artificial Sequence
  Description of Artificial Sequence: Synthetic oligonucleotide
aaacuugucaaaguagcuuccauuuau

SEQ ID NO: 1535 - RNA, 27 nt, Artificial Sequence
  Description of Artificial Sequence: Synthetic oligonucleotide
ugaaauuagucaaaguagcuuccauuu

SEQ ID NO: 1536 - RNA, 27 nt, Artificial Sequence
  Description of Artificial Sequence: Synthetic oligonucleotide
ucugauacuagucaaaguagcuuccau

SEQ ID NO: 1537 - RNA, 36 nt, Artificial Sequence
  Description of Artificial Sequence: Synthetic oligonucleotide
cgggacagguuuuggcuugagcagccgaaaggcugc

SEQ ID NO: 1538 - RNA, 36 nt, Artificial Sequence
  Description of Artificial Sequence: Synthetic oligonucleotide
ggacagguuuuggcuugugagcagccgaaaggcugc

SEQ ID NO: 1539 - RNA, 36 nt, Artificial Sequence
  Description of Artificial Sequence: Synthetic oligonucleotide
gacagguuuuggcuugugaagcagccgaaaggcugc

SEQ ID NO: 1540 - RNA, 36 nt, Artificial Sequence
  Description of Artificial Sequence: Synthetic oligonucleotide
agguuuuggcuugugaucaagcagccgaaaggcugc

SEQ ID NO: 1541 - RNA, 36 nt, Artificial Sequence
  Description of Artificial Sequence: Synthetic oligonucleotide
gguuuuggcuugugaucaaagcagccgaaaggcugc

SEQ ID NO: 1542 - RNA, 36 nt, Artificial Sequence
  Description of Artificial Sequence: Synthetic oligonucleotide
aggcuagagaagaaaguuaagcagccgaaaggcugc

SEQ ID NO: 1543 - RNA, 36 nt, Artificial Sequence
  Description of Artificial Sequence: Synthetic oligonucleotide
ggcuagagaagaaaguuaaagcagccgaaaggcugc

SEQ ID NO: 1544 - RNA, 36 nt, Artificial Sequence
  Description of Artificial Sequence: Synthetic oligonucleotide
aggaugcgaugucuaugcaagcagccgaaaggcugc

SEQ ID NO: 1545 - RNA, 36 nt, Artificial Sequence
  Description of Artificial Sequence: Synthetic oligonucleotide
uuguuccagaugcauuuuaagcagccgaaaggcugc

SEQ ID NO: 1546 - RNA, 36 nt, Artificial Sequence
  Description of Artificial Sequence: Synthetic oligonucleotide
uuugugauuuucacauuuuagcagccgaaaggcugc

SEQ ID NO: 1547 - RNA, 36 nt, Artificial Sequence
  Description of Artificial Sequence: Synthetic oligonucleotide
aaacugugaauaaauggaaagcagccgaaaggcugc

SEQ ID NO: 1548 - RNA, 36 nt, Artificial Sequence
  Description of Artificial Sequence: Synthetic oligonucleotide
aacugugaauaaauggaagagcagccgaaaggcugc

SEQ ID NO: 1549 - RNA, 36 nt, Artificial Sequence
  Description of Artificial Sequence: Synthetic oligonucleotide
aggaccagauugcuuacucagcagccgaaaggcugc

SEQ ID NO: 1550 - RNA, 36 nt, Artificial Sequence
  Description of Artificial Sequence: Synthetic oligonucleotide
gaaagcauaugucaguuguagcagccgaaaggcugc

SEQ ID NO: 1551 - RNA, 36 nt, Artificial Sequence
  Description of Artificial Sequence: Synthetic oligonucleotide
uaugucaguuguuuaaaacagcagccgaaaggcugc

SEQ ID NO: 1552 - RNA, 36 nt, Artificial Sequence
  Description of Artificial Sequence: Synthetic oligonucleotide
guuuaaaacccaauaucuaagcagccgaaaggcugc

SEQ ID NO: 1553 - RNA, 36 nt, Artificial Sequence
  Description of Artificial Sequence: Synthetic oligonucleotide
ugugaauaaauggaagcuaagcagccgaaaggcugc

SEQ ID NO: 1554 - RNA, 36 nt, Artificial Sequence
  Description of Artificial Sequence: Synthetic oligonucleotide
cgauggugacacccugacuagcagccgaaaggcugc

SEQ ID NO: 1555 - RNA, 36 nt, Artificial Sequence
  Description of Artificial Sequence: Synthetic oligonucleotide
uggugacacccugacucucagcagccgaaaggcugc

SEQ ID NO: 1556 - RNA, 36 nt, Artificial Sequence
  Description of Artificial Sequence: Synthetic oligonucleotide
cgagacguccucaucaaauagcagccgaaaggcugc

SEQ ID NO: 1557 - RNA, 36 nt, Artificial Sequence
  Description of Artificial Sequence: Synthetic oligonucleotide
aauagcagacuuguuccgaagcagccgaaaggcugc

SEQ ID NO: 1558 - RNA, 36 nt, Artificial Sequence
  Description of Artificial Sequence: Synthetic oligonucleotide
cccaaggaccagauugcuuagcagccgaaaggcugc

SEQ ID NO: 1559 - RNA, 36 nt, Artificial Sequence
  Description of Artificial Sequence: Synthetic oligonucleotide
aaggaccagauugcuuacuagcagccgaaaggcugc

SEQ ID NO: 1560 - RNA, 36 nt, Artificial Sequence
  Description of Artificial Sequence: Synthetic oligonucleotide
agaacgaaaguuauauggaagcagccgaaaggcugc

SEQ ID NO: 1561 - RNA, 36 nt, Artificial Sequence
  Description of Artificial Sequence: Synthetic oligonucleotide
gaacgaaaguuauauggaaagcagccgaaaggcugc

SEQ ID NO: 1562 - RNA, 36 nt, Artificial Sequence
  Description of Artificial Sequence: Synthetic oligonucleotide
aacgaaaguuauauggaaaagcagccgaaaggcugc

SEQ ID NO: 1563 - RNA, 36 nt, Artificial Sequence
  Description of Artificial Sequence: Synthetic oligonucleotide
cgaaaguuauauggaaaauagcagccgaaaggcugc

SEQ ID NO: 1564 - RNA, 36 nt, Artificial Sequence
  Description of Artificial Sequence: Synthetic oligonucleotide
aauuugugauuuucacauuagcagccgaaaggcugc

SEQ ID NO: 1565 - RNA, 36 nt, Artificial Sequence
  Description of Artificial Sequence: Synthetic oligonucleotide
uuguuuaaaacccaauaucagcagccgaaaggcugc

SEQ ID NO: 1566 - RNA, 36 nt, Artificial Sequence
  Description of Artificial Sequence: Synthetic oligonucleotide
uguuuaaaacccaauaucuagcagccgaaaggcugc

SEQ ID NO: 1567 - RNA, 36 nt, Artificial Sequence
  Description of Artificial Sequence: Synthetic oligonucleotide
ugccauuuuguccuuugauagcagccgaaaggcugc

SEQ ID NO: 1568 - RNA, 36 nt, Artificial Sequence
  Description of Artificial Sequence: Synthetic oligonucleotide
aaguugacuaaacuugaaaagcagccgaaaggcugc

SEQ ID NO: 1569 - RNA, 36 nt, Artificial Sequence
  Description of Artificial Sequence: Synthetic oligonucleotide
uugacuaaacuugaaaaauagcagccgaaaggcugc

SEQ ID NO: 1570 - RNA, 36 nt, Artificial Sequence
  Description of Artificial Sequence: Synthetic oligonucleotide
aaaacugugaauaaauggaagcagccgaaaggcugc

SEQ ID NO: 1571 - RNA, 36 nt, Artificial Sequence
  Description of Artificial Sequence: Synthetic oligonucleotide
cgagcaagcacuauauggaagcagccgaaaggcugc

SEQ ID NO: 1572 - RNA, 36 nt, Artificial Sequence
  Description of Artificial Sequence: Synthetic oligonucleotide
aagaauguuccagaauguuagcagccgaaaggcugc

SEQ ID NO: 1573 - RNA, 22 nt, Artificial Sequence
  Description of Artificial Sequence: Synthetic oligonucleotide
ucaagccaaaaccugucccggg

SEQ ID NO: 1574 - RNA, 22 nt, Artificial Sequence
  Description of Artificial Sequence: Synthetic oligonucleotide
ucacaagccaaaaccuguccgg

SEQ ID NO: 1575 - RNA, 22 nt, Artificial Sequence
  Description of Artificial Sequence: Synthetic oligonucleotide
uucacaagccaaaaccugucgg

SEQ ID NO: 1576 - RNA, 22 nt, Artificial Sequence
  Description of Artificial Sequence: Synthetic oligonucleotide
uugaucacaagccaaaaccugg

SEQ ID NO: 1577 - RNA, 22 nt, Artificial Sequence
  Description of Artificial Sequence: Synthetic oligonucleotide
uuugaucacaagccaaaaccgg

SEQ ID NO: 1578 - RNA, 22 nt, Artificial Sequence
  Description of Artificial Sequence: Synthetic oligonucleotide
uuaacuuucuucucuagccugg

SEQ ID NO: 1579 - RNA, 22 nt, Artificial Sequence
  Description of Artificial Sequence: Synthetic oligonucleotide
uuuaacuuucuucucuagccgg

SEQ ID NO: 1580 - RNA, 22 nt, Artificial Sequence
  Description of Artificial Sequence: Synthetic oligonucleotide
uugcauagacaucgcauccugg

SEQ ID NO: 1581 - RNA, 22 nt, Artificial Sequence
  Description of Artificial Sequence: Synthetic oligonucleotide
uuaaaaugcaucuggaacaagg

SEQ ID NO: 1582 - RNA, 22 nt, Artificial Sequence
  Description of Artificial Sequence: Synthetic oligonucleotide
uaaaaugugaaaaucacaaagg

SEQ ID NO: 1583 - RNA, 22 nt, Artificial Sequence
  Description of Artificial Sequence: Synthetic oligonucleotide
uuuccauuuauucacaguuugg

SEQ ID NO: 1584 - RNA, 22 nt, Artificial Sequence
  Description of Artificial Sequence: Synthetic oligonucleotide
ucuuccauuuauucacaguugg

SEQ ID NO: 1585 - RNA, 22 nt, Artificial Sequence
  Description of Artificial Sequence: Synthetic oligonucleotide
ugaguaagcaaucugguccugg

SEQ ID NO: 1586 - RNA, 22 nt, Artificial Sequence
  Description of Artificial Sequence: Synthetic oligonucleotide
uacaacugacauaugcuuucgg

SEQ ID NO: 1587 - RNA, 22 nt, Artificial Sequence
  Description of Artificial Sequence: Synthetic oligonucleotide
uguuuuaaacaacugacauagg

SEQ ID NO: 1588 - RNA, 22 nt, Artificial Sequence
  Description of Artificial Sequence: Synthetic oligonucleotide
uuagauauuggguuuuaaacgg

SEQ ID NO: 1589 - RNA, 22 nt, Artificial Sequence
  Description of Artificial Sequence: Synthetic oligonucleotide
uuagcuuccauuuauucacagg

SEQ ID NO: 1590 - RNA, 22 nt, Artificial Sequence
  Description of Artificial Sequence: Synthetic oligonucleotide
uagucagggugucaccaucggg

SEQ ID NO: 1591 - RNA, 22 nt, Artificial Sequence
  Description of Artificial Sequence: Synthetic oligonucleotide
ugagagucagggugucaccagg

SEQ ID NO: 1592 - RNA, 22 nt, Artificial Sequence
  Description of Artificial Sequence: Synthetic oligonucleotide
uauuugaugaggacgucucggg

SEQ ID NO: 1593 - RNA, 22 nt, Artificial Sequence
  Description of Artificial Sequence: Synthetic oligonucleotide
uucggaacaagucugcuauugg

SEQ ID NO: 1594 - RNA, 22 nt, Artificial Sequence
  Description of Artificial Sequence: Synthetic oligonucleotide
uaagcaaucugguccuuggggg

SEQ ID NO: 1595 - RNA, 22 nt, Artificial Sequence
  Description of Artificial Sequence: Synthetic oligonucleotide
uaguaagcaaucugguccuugg

SEQ ID NO: 1596 - RNA, 22 nt, Artificial Sequence
  Description of Artificial Sequence: Synthetic oligonucleotide
uuccauauaacuuucguucugg

SEQ ID NO: 1597 - RNA, 22 nt, Artificial Sequence
  Description of Artificial Sequence: Synthetic oligonucleotide
uuuccauauaacuuucguucgg

SEQ ID NO: 1598 - RNA, 22 nt, Artificial Sequence
  Description of Artificial Sequence: Synthetic oligonucleotide
uuuuccauauaacuuucguugg

SEQ ID NO: 1599 - RNA, 22 nt, Artificial Sequence
  Description of Artificial Sequence: Synthetic oligonucleotide
uauuuuccauauaacuuucggg

SEQ ID NO: 1600 - RNA, 22 nt, Artificial Sequence
  Description of Artificial Sequence: Synthetic oligonucleotide
uaaugugaaaaucacaaauugg

SEQ ID NO: 1601 - RNA, 22 nt, Artificial Sequence
  Description of Artificial Sequence: Synthetic oligonucleotide
ugauauuggguuuuaaacaagg

SEQ ID NO: 1602 - RNA, 22 nt, Artificial Sequence
  Description of Artificial Sequence: Synthetic oligonucleotide
uagauauuggguuuuaaacagg

SEQ ID NO: 1603 - RNA, 22 nt, Artificial Sequence
  Description of Artificial Sequence: Synthetic oligonucleotide
uaucaaaggacaaaauggcagg

SEQ ID NO: 1604 - RNA, 22 nt, Artificial Sequence
  Description of Artificial Sequence: Synthetic oligonucleotide
uuuucaaguuuagucaacuugg

SEQ ID NO: 1605 - RNA, 22 nt, Artificial Sequence
  Description of Artificial Sequence: Synthetic oligonucleotide
uauuuuucaaguuuagucaagg

SEQ ID NO: 1606 - RNA, 22 nt, Artificial Sequence
  Description of Artificial Sequence: Synthetic oligonucleotide
uuccauuuauucacaguuuugg

SEQ ID NO: 1607 - RNA, 22 nt, Artificial Sequence
  Description of Artificial Sequence: Synthetic oligonucleotide
uuccauauagugcuugcucggg

SEQ ID NO: 1608 - RNA, 22 nt, Artificial Sequence
  Description of Artificial Sequence: Synthetic oligonucleotide
uaacauucuggaacauucuugg

SEQ ID NO: 1609 - RNA, 36 nt, Artificial Sequence; identical to SEQ ID NO: 1537
  Description of Artificial Sequence: Synthetic oligonucleotide
  modified_base (1)..(1): 2'-O-methyl modified nucleotide with a phosphorothioate linkage to the neighboring nucleotide
  modified_base (2)..(2): 2'-O-methyl modified nucleotide with phosphodiester linkages to neighboring nucleotides
  modified_base (3)..(3): 2'-O-methyl modified nucleotide with phosphodiester linkages to neighboring nucleotides
  modified_base (4)..(4): 2'-O-methyl modified nucleotide with phosphodiester linkages to neighboring nucleotides
  modified_base (5)..(5): 2'-O-methyl modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'-O-methyl modified nucleotide with phosphodiester linkages to neighboring nucleotides
  modified_base (8)..(8): 2'- fluoro modified nucleotide with phosphodiester linkages to neighboring nucleotides
  modified_base (9)..(9): 2'- fluoro modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'- fluoro modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'-O-methyl modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with phosphodiester linkages to neighboring nucleotides
  modified_base (21)..(21): 2'-O-methyl modified nucleotide with phosphodiester linkages to neighboring nucleotides
  modified_base (22)..(22): 2'-O-methyl modified nucleotide with phosphodiester linkages to neighboring nucleotides
  modified_base (23)..(23): 2'-O-methyl modified nucleotide with phosphodiester linkages to neighboring nucleotides
  modified_base (24)..(24): 2'-O-methyl modified nucleotide with phosphodiester linkages to neighboring nucleotides
  modified_base (25)..(25): 2'-O-methyl modified nucleotide with phosphodiester linkages to neighboring nucleotides
  modified_base (26)..(26): 2'-O-methyl modified nucleotide with phosphodiester linkages to neighboring nucleotides
  modified_base (27)..(27): 2'-O-methyl modified nucleotide with phosphodiester linkages to neighboring nucleotides
  modified_base (28)..(28): GalNAc attached to an adenine nucleotide
  modified_base (29)..(29): GalNAc attached to an adenine nucleotide
  modified_base (30)..(30): GalNAc attached to an adenine nucleotide
  modified_base (31)..(31): 2'-O-methyl modified nucleotide with phosphodiester linkages to neighboring nucleotides
  modified_base (32)..(32): 2'-O-methyl modified nucleotide with phosphodiester linkages to neighboring nucleotides
  modified_base (33)..(33): 2'-O-methyl modified nucleotide with phosphodiester linkages to neighboring nucleotides
  modified_base (34)..(34): 2'-O-methyl modified nucleotide with phosphodiester linkages to neighboring nucleotides
  modified_base (35)..(35): 2'-O-methyl modified nucleotide with phosphodiester linkages to neighboring nucleotides
  modified_base (36)..(36): 2'-O-methyl modified nucleotide

SEQ ID NO: 1610 - RNA, 36 nt, Artificial Sequence; identical to SEQ ID NO: 1538
  Description of Artificial Sequence: Synthetic oligonucleotide
  modified_base (1)..(1): 2'-O-methyl modified nucleotide with a phosphorothioate linkage to the neighboring nucleotide
  modified_base (2)..(2): 2'-O-methyl modified nucleotide with phosphodiester linkages to neighboring nucleotides
  modified_base (3)..(3): 2'-O-methyl modified nucleotide with phosphodiester linkages to neighboring nucleotides
  modified_base (4)..(4): 2'-O-methyl modified nucleotide with phosphodiester linkages to neighboring nucleotides
  modified_base (5)..(5): 2'-O-methyl modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'-O-methyl modified nucleotide with phosphodiester linkages to neighboring nucleotides
  modified_base (8)..(8): 2'- fluoro modified nucleotide with phosphodiester linkages to neighboring nucleotides
  modified_base (9)..(9): 2'- fluoro modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'- fluoro modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'-O-methyl modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with phosphodiester linkages to neighboring nucleotides
  modified_base (21)..(21): 2'-O-methyl modified nucleotide with phosphodiester linkages to neighboring nucleotides
  modified_base (22)..(22): 2'-O-methyl modified nucleotide with phosphodiester linkages to neighboring nucleotides
  modified_base (23)..(23): 2'-O-methyl modified nucleotide with phosphodiester linkages to neighboring nucleotides
  modified_base (24)..(24): 2'-O-methyl modified nucleotide with phosphodiester linkages to neighboring nucleotides
  modified_base (25)..(25): 2'-O-methyl modified nucleotide with phosphodiester linkages to neighboring nucleotides
  modified_base (26)..(26): 2'-O-methyl modified nucleotide with phosphodiester linkages to neighboring nucleotides
  modified_base (27)..(27): 2'-O-methyl modified nucleotide with phosphodiester linkages to neighboring nucleotides
  modified_base (28)..(28): GalNAc attached to an adenine nucleotide
  modified_base (29)..(29): GalNAc attached to an adenine nucleotide
  modified_base (30)..(30): GalNAc attached to an adenine nucleotide
  modified_base (31)..(31): 2'-O-methyl modified nucleotide with phosphodiester linkages to neighboring nucleotides
  modified_base (32)..(32): 2'-O-methyl modified nucleotide with phosphodiester linkages to neighboring nucleotides
  modified_base (33)..(33): 2'-O-methyl modified nucleotide with phosphodiester linkages to neighboring nucleotides
  modified_base (34)..(34): 2'-O-methyl modified nucleotide with phosphodiester linkages to neighboring nucleotides
  modified_base (35)..(35): 2'-O-methyl modified nucleotide with phosphodiester linkages to neighboring nucleotides
  modified_base (36)..(36): 2'-O-methyl modified nucleotide

SEQ ID NO: 1611 - RNA, 36 nt, Artificial Sequence; identical to SEQ ID NO: 1539
  Description of Artificial Sequence: Synthetic oligonucleotide
  modified_base (1)..(1): 2'-O-methyl modified nucleotide with a phosphorothioate linkage to the neighboring nucleotide
  modified_base (2)..(2): 2'-O-methyl modified nucleotide with phosphodiester linkages to neighboring nucleotides
  modified_base (3)..(3): 2'-O-methyl modified nucleotide with phosphodiester linkages to neighboring nucleotides
  modified_base (4)..(4): 2'-O-methyl modified nucleotide with phosphodiester linkages to neighboring nucleotides
  modified_base (5)..(5): 2'-O-methyl modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'-O-methyl modified nucleotide with phosphodiester linkages to neighboring nucleotides
  modified_base (8)..(8): 2'- fluoro modified nucleotide with phosphodiester linkages to neighboring nucleotides
  modified_base (9)..(9): 2'- fluoro modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'- fluoro modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'-O-methyl modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with phosphodiester linkages to neighboring nucleotides
  modified_base (21)..(21): 2'-O-methyl modified nucleotide with phosphodiester linkages to neighboring nucleotides
  modified_base (22)..(22): 2'-O-methyl modified nucleotide with phosphodiester linkages to neighboring nucleotides
  modified_base (23)..(23): 2'-O-methyl modified nucleotide with phosphodiester linkages to neighboring nucleotides
  modified_base (24)..(24): 2'-O-methyl modified nucleotide with phosphodiester linkages to neighboring nucleotides
  modified_base (25)..(25): 2'-O-methyl modified nucleotide with phosphodiester linkages to neighboring nucleotides
  modified_base (26)..(26): 2'-O-methyl modified nucleotide with phosphodiester linkages to neighboring nucleotides
  modified_base (27)..(27): 2'-O-methyl modified nucleotide with phosphodiester linkages to neighboring nucleotides
  modified_base (28)..(28): GalNAc attached to an adenine nucleotide
  modified_base (29)..(29): GalNAc attached to an adenine nucleotide
  modified_base (30)..(30): GalNAc attached to an adenine nucleotide
  modified_base (31)..(31): 2'-O-methyl modified nucleotide with phosphodiester linkages to neighboring nucleotides
  modified_base (32)..(32): 2'-O-methyl modified nucleotide with phosphodiester linkages to neighboring nucleotides
  modified_base (33)..(33): 2'-O-methyl modified nucleotide with phosphodiester linkages to neighboring nucleotides
  modified_base (34)..(34): 2'-O-methyl modified nucleotide with phosphodiester linkages to neighboring nucleotides
  modified_base (35)..(35): 2'-O-methyl modified nucleotide with phosphodiester linkages to neighboring nucleotides
  modified_base (36)..(36): 2'-O-methyl modified nucleotide

SEQ ID NO: 1612 - RNA, 36 nt, Artificial Sequence; identical to SEQ ID NO: 1540
  Description of Artificial Sequence: Synthetic oligonucleotide
  modified_base (1)..(1): 2'-O-methyl modified nucleotide with a phosphorothioate linkage to the neighboring nucleotide
  modified_base (2)..(2): 2'-O-methyl modified nucleotide with phosphodiester linkages to neighboring nucleotides
  modified_base (3)..(3): 2'-O-methyl modified nucleotide with phosphodiester linkages to neighboring nucleotides
  modified_base (4)..(4): 2'-O-methyl modified nucleotide with phosphodiester linkages to neighboring nucleotides
  modified_base (5)..(5): 2'-O-methyl modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'-O-methyl modified nucleotide with phosphodiester linkages to neighboring nucleotides
  modified_base (8)..(8): 2'- fluoro modified nucleotide with phosphodiester linkages to neighboring nucleotides
  modified_base (9)..(9): 2'- fluoro modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'- fluoro modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'-O-methyl modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with phosphodiester linkages to neighboring nucleotides
  modified_base (21)..(21): 2'-O-methyl modified nucleotide with phosphodiester linkages to neighboring nucleotides
  modified_base (22)..(22): 2'-O-methyl modified nucleotide with phosphodiester linkages to neighboring nucleotides
  modified_base (23)..(23): 2'-O-methyl modified nucleotide with phosphodiester linkages to neighboring nucleotides
  modified_base (24)..(24): 2'-O-methyl modified nucleotide with phosphodiester linkages to neighboring nucleotides
  modified_base (25)..(25): 2'-O-methyl modified nucleotide with phosphodiester linkages to neighboring nucleotides
  modified_base (26)..(26): 2'-O-methyl modified nucleotide with phosphodiester linkages to neighboring nucleotides
  modified_base (27)..(27): 2'-O-methyl modified nucleotide with phosphodiester linkages to neighboring nucleotides
  modified_base (28)..(28): GalNAc attached to an adenine nucleotide
  modified_base (29)..(29): GalNAc attached to an adenine nucleotide
  modified_base (30)..(30): GalNAc attached to an adenine nucleotide
  modified_base (31)..(31): 2'-O-methyl modified nucleotide with phosphodiester linkages to neighboring nucleotides
  modified_base (32)..(32): 2'-O-methyl modified nucleotide with phosphodiester linkages to neighboring nucleotides
  modified_base (33)..(33): 2'-O-methyl modified nucleotide with phosphodiester linkages to neighboring nucleotides
  modified_base (34)..(34): 2'-O-methyl modified nucleotide with phosphodiester linkages to neighboring nucleotides
  modified_base (35)..(35): 2'-O-methyl modified nucleotide with phosphodiester linkages to neighboring nucleotides
  modified_base (36)..(36): 2'-O-methyl modified nucleotide

SEQ ID NO: 1613 - RNA, 36 nt, Artificial Sequence; identical to SEQ ID NO: 1541
  Description of Artificial Sequence: Synthetic oligonucleotide
  modified_base (1)..(1): 2'-O-methyl modified nucleotide with a phosphorothioate linkage to the neighboring nucleotide
  modified_base (2)..(2): 2'-O-methyl modified nucleotide with phosphodiester linkages to neighboring nucleotides
  modified_base (3)..(3): 2'-O-methyl modified nucleotide with phosphodiester linkages to neighboring nucleotides
  modified_base (4)..(4): 2'-O-methyl modified nucleotide with phosphodiester linkages to neighboring nucleotides
  modified_base (5)..(5): 2'-O-methyl modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'-O-methyl modified nucleotide with phosphodiester linkages to neighboring nucleotides
  modified_base (8)..(8): 2'- fluoro modified nucleotide with phosphodiester linkages to neighboring nucleotides
  modified_base (9)..(9): 2'- fluoro modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'- fluoro modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'-O-methyl modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with phosphodiester linkages to neighboring nucleotides
  modified_base (21)..(21): 2'-O-methyl modified nucleotide with phosphodiester linkages to neighboring nucleotides
  modified_base (22)..(22): 2'-O-methyl modified nucleotide with phosphodiester linkages to neighboring nucleotides
  modified_base (23)..(23): 2'-O-methyl modified nucleotide with phosphodiester linkages to neighboring nucleotides
  modified_base (24)..(24): 2'-O-methyl modified nucleotide with phosphodiester linkages to neighboring nucleotides
  modified_base (25)..(25): 2'-O-methyl modified nucleotide with phosphodiester linkages to neighboring nucleotides
  modified_base (26)..(26): 2'-O-methyl modified nucleotide with phosphodiester linkages to neighboring nucleotides
  modified_base (27)..(27): 2'-O-methyl modified nucleotide with phosphodiester linkages to neighboring nucleotides
  modified_base (28)..(28): GalNAc attached to an adenine nucleotide
  modified_base (29)..(29): GalNAc attached to an adenine nucleotide
  modified_base (30)..(30): GalNAc attached to an adenine nucleotide
  modified_base (31)..(31): 2'-O-methyl modified nucleotide with phosphodiester linkages to neighboring nucleotides
  modified_base (32)..(32): 2'-O-methyl modified nucleotide with phosphodiester linkages to neighboring nucleotides
  modified_base (33)..(33): 2'-O-methyl modified nucleotide with phosphodiester linkages to neighboring nucleotides
  modified_base (34)..(34): 2'-O-methyl modified nucleotide with phosphodiester linkages to neighboring nucleotides
  modified_base (35)..(35): 2'-O-methyl modified nucleotide with phosphodiester linkages to neighboring nucleotides
  modified_base (36)..(36): 2'-O-methyl modified nucleotide

SEQ ID NO: 1614 - RNA, 36 nt, Artificial Sequence; identical to SEQ ID NO: 1542
  Description of Artificial Sequence: Synthetic oligonucleotide
  modified_base (1)..(1): 2'-O-methyl modified nucleotide with a phosphorothioate linkage to the neighboring nucleotide
  modified_base (2)..(2): 2'-O-methyl modified nucleotide with phosphodiester linkages to neighboring nucleotides
  modified_base (3)..(3): 2'-O-methyl modified nucleotide with phosphodiester linkages to neighboring nucleotides
  modified_base (4)..(4): 2'-O-methyl modified nucleotide with phosphodiester linkages to neighboring nucleotides
  modified_base (5)..(5): 2'-O-methyl modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'-O-methyl modified nucleotide with phosphodiester linkages to neighboring nucleotides
  modified_base (8)..(8): 2'- fluoro modified nucleotide with phosphodiester linkages to neighboring nucleotides
  modified_base (9)..(9): 2'- fluoro modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'- fluoro modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'-O-methyl modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with phosphodiester linkages to neighboring nucleotides
  modified_base (21)..(21): 2'-O-methyl modified nucleotide with phosphodiester linkages to neighboring nucleotides
  modified_base (22)..(22): 2'-O-methyl modified nucleotide with phosphodiester linkages to neighboring nucleotides
  modified_base (23)..(23): 2'-O-methyl modified nucleotide with phosphodiester linkages to neighboring nucleotides
  modified_base (24)..(24): 2'-O-methyl modified nucleotide with phosphodiester linkages to neighboring nucleotides
  modified_base (25)..(25): 2'-O-methyl modified nucleotide with phosphodiester linkages to neighboring nucleotides
  modified_base (26)..(26): 2'-O-methyl modified nucleotide with phosphodiester linkages to neighboring nucleotides
  modified_base (27)..(27): 2'-O-methyl modified nucleotide with phosphodiester linkages to neighboring nucleotides
  modified_base (28)..(28): GalNAc attached to an adenine nucleotide
  modified_base (29)..(29): GalNAc attached to an adenine nucleotide
  modified_base (30)..(30): GalNAc attached to an adenine nucleotide
  modified_base (31)..(31): 2'-O-methyl modified nucleotide with phosphodiester linkages to neighboring nucleotides
  modified_base (32)..(32): 2'-O-methyl modified nucleotide with phosphodiester linkages to neighboring nucleotides
  modified_base (33)..(33): 2'-O-methyl modified nucleotide with phosphodiester linkages to neighboring nucleotides
  modified_base (34)..(34): 2'-O-methyl modified nucleotide with phosphodiester linkages to neighboring nucleotides
  modified_base (35)..(35): 2'-O-methyl modified nucleotide with phosphodiester linkages to neighboring nucleotides
  modified_base (36)..(36): 2'-O-methyl modified nucleotide

SEQ ID NO: 1615 - RNA, 36 nt, Artificial Sequence; identical to SEQ ID NO: 1543
  Description of Artificial Sequence: Synthetic oligonucleotide
  modified_base (1)..(1): 2'-O-methyl modified nucleotide with a phosphorothioate linkage to the neighboring nucleotide
  modified_base (2)..(2): 2'-O-methyl modified nucleotide with phosphodiester linkages to neighboring nucleotides
  modified_base (3)..(3): 2'-O-methyl modified nucleotide with phosphodiester linkages to neighboring nucleotides
  modified_base (4)..(4): 2'-O-methyl modified nucleotide with phosphodiester linkages to neighboring nucleotides
  modified_base (5)..(5): 2'-O-methyl modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'-O-methyl modified nucleotide with phosphodiester linkages to neighboring nucleotides
  modified_base (8)..(8): 2'- fluoro modified nucleotide with phosphodiester linkages to neighboring nucleotides
  modified_base (9)..(9): 2'- fluoro modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'- fluoro modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'-O-methyl modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with phosphodiester linkages to neighboring nucleotides
  modified_base (21)..(21): 2'-O-methyl modified nucleotide with phosphodiester linkages to neighboring nucleotides
  modified_base (22)..(22): 2'-O-methyl modified nucleotide with phosphodiester linkages to neighboring nucleotides
  modified_base (23)..(23): 2'-O-methyl modified nucleotide with phosphodiester linkages to neighboring nucleotides
  modified_base (24)..(24): 2'-O-methyl modified nucleotide with phosphodiester linkages to neighboring nucleotides
  modified_base (25)..(25): 2'-O-methyl modified nucleotide with phosphodiester linkages to neighboring nucleotides
  modified_base (26)..(26): 2'-O-methyl modified nucleotide with phosphodiester linkages to neighboring nucleotides
  modified_base (27)..(27): 2'-O-methyl modified nucleotide with phosphodiester linkages to neighboring nucleotides
  modified_base (28)..(28): GalNAc attached to an adenine nucleotide
  modified_base (29)..(29): GalNAc attached to an adenine nucleotide
  modified_base (30)..(30): GalNAc attached to an adenine nucleotide
  modified_base (31)..(31): 2'-O-methyl modified nucleotide with phosphodiester linkages to neighboring nucleotides
  modified_base (32)..(32): 2'-O-methyl modified nucleotide with phosphodiester linkages to neighboring nucleotides
  modified_base (33)..(33): 2'-O-methyl modified nucleotide with phosphodiester linkages to neighboring nucleotides
  modified_base (34)..(34): 2'-O-methyl modified nucleotide with phosphodiester linkages to neighboring nucleotides
  modified_base (35)..(35): 2'-O-methyl modified nucleotide with phosphodiester linkages to neighboring nucleotides
  modified_base (36)..(36): 2'-O-methyl modified nucleotide

SEQ ID NO: 1616 - RNA, 36 nt, Artificial Sequence; identical to SEQ ID NO: 1544
  Description of Artificial Sequence: Synthetic oligonucleotide
  modified_base (1)..(1): 2'-O-methyl modified nucleotide with a phosphorothioate linkage to the neighboring nucleotide
  modified_base (2)..(2): 2'-O-methyl modified nucleotide with phosphodiester linkages to neighboring nucleotides
  modified_base (3)..(3): 2'-O-methyl modified nucleotide with phosphodiester linkages to neighboring nucleotides
  modified_base (4)..(4): 2'-O-methyl modified nucleotide with phosphodiester linkages to neighboring nucleotides
  modified_base (5)..(5): 2'-O-methyl modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'-O-methyl modified nucleotide with phosphodiester linkages to neighboring nucleotides
  modified_base (8)..(8): 2'- fluoro modified nucleotide with phosphodiester linkages to neighboring nucleotides
  modified_base (9)..(9): 2'- fluoro modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'- fluoro modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'-O-methyl modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with phosphodiester linkages to neighboring nucleotides
  modified_base (21)..(21): 2'-O-methyl modified nucleotide with phosphodiester linkages to neighboring nucleotides
  modified_base (22)..(22): 2'-O-methyl modified nucleotide with phosphodiester linkages to neighboring nucleotides
  modified_base (23)..(23): 2'-O-methyl modified nucleotide with phosphodiester linkages to neighboring nucleotides
  modified_base (24)..(24): 2'-O-methyl modified nucleotide with phosphodiester linkages to neighboring nucleotides
  modified_base (25)..(25): 2'-O-methyl modified nucleotide with phosphodiester linkages to neighboring nucleotides
  modified_base (26)..(26): 2'-O-methyl modified nucleotide with phosphodiester linkages to neighboring nucleotides
  modified_base (27)..(27): 2'-O-methyl modified nucleotide with phosphodiester linkages to neighboring nucleotides
  modified_base (28)..(28): GalNAc attached to an adenine nucleotide
  modified_base (29)..(29): GalNAc attached to an adenine nucleotide
  modified_base (30)..(30): GalNAc attached to an adenine nucleotide
  modified_base (31)..(31): 2'-O-methyl modified nucleotide with phosphodiester linkages to neighboring nucleotides
  modified_base (32)..(32): 2'-O-methyl modified nucleotide with phosphodiester linkages to neighboring nucleotides
  modified_base (33)..(33): 2'-O-methyl modified nucleotide with phosphodiester linkages to neighboring nucleotides
  modified_base (34)..(34): 2'-O-methyl modified nucleotide with phosphodiester linkages to neighboring nucleotides
  modified_base (35)..(35): 2'-O-methyl modified nucleotide with phosphodiester linkages to neighboring nucleotides
  modified_base (36)..(36): 2'-O-methyl modified nucleotide

SEQ ID NO: 1617 - RNA, 36 nt, Artificial Sequence; identical to SEQ ID NO: 1545
  Description of Artificial Sequence: Synthetic oligonucleotide
  modified_base (1)..(1): 2'-O-methyl modified nucleotide with a phosphorothioate linkage to the neighboring nucleotide
  modified_base (2)..(2): 2'-O-methyl modified nucleotide with phosphodiester linkages to neighboring nucleotides
  modified_base (3)..(3): 2'-O-methyl modified nucleotide with phosphodiester linkages to neighboring nucleotides
  modified_base (4)..(4): 2'-O-methyl modified nucleotide with phosphodiester linkages to neighboring nucleotides
  modified_base (5)..(5): 2'-O-methyl modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'-O-methyl modified nucleotide with phosphodiester linkages to neighboring nucleotides
  modified_base (8)..(8): 2'- fluoro modified nucleotide with phosphodiester linkages to neighboring nucleotides
  modified_base (9)..(9): 2'- fluoro modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'- fluoro modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'-O-methyl modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with phosphodiester linkages to neighboring nucleotides
  modified_base (21)..(21): 2'-O-methyl modified nucleotide with phosphodiester linkages to neighboring nucleotides
  modified_base (22)..(22): 2'-O-methyl modified nucleotide with phosphodiester linkages to neighboring nucleotides
  modified_base (23)..(23): 2'-O-methyl modified nucleotide with phosphodiester linkages to neighboring nucleotides
  modified_base (24)..(24): 2'-O-methyl modified nucleotide with phosphodiester linkages to neighboring nucleotides
  modified_base (25)..(25): 2'-O-methyl modified nucleotide with phosphodiester linkages to neighboring nucleotides
  modified_base (26)..(26): 2'-O-methyl modified nucleotide with phosphodiester linkages to neighboring nucleotides
  modified_base (27)..(27): 2'-O-methyl modified nucleotide with phosphodiester linkages to neighboring nucleotides
  modified_base (28)..(28): GalNAc attached to an adenine nucleotide
  modified_base (29)..(29): GalNAc attached to an adenine nucleotide
  modified_base (30)..(30): GalNAc attached to an adenine nucleotide
  modified_base (31)..(31): 2'-O-methyl modified nucleotide with phosphodiester linkages to neighboring nucleotides
  modified_base (32)..(32): 2'-O-methyl modified nucleotide with phosphodiester linkages to neighboring nucleotides
  modified_base (33)..(33): 2'-O-methyl modified nucleotide with phosphodiester linkages to neighboring nucleotides
  modified_base (34)..(34): 2'-O-methyl modified nucleotide with phosphodiester linkages to neighboring nucleotides
  modified_base (35)..(35): 2'-O-methyl modified nucleotide with phosphodiester linkages to neighboring nucleotides
  modified_base (36)..(36): 2'-O-methyl modified nucleotide

SEQ ID NO: 1618 - RNA, 36 nt, Artificial Sequence; identical to SEQ ID NO: 1546
  Description of Artificial Sequence: Synthetic oligonucleotide
  modified_base (1)..(1): 2'-O-methyl modified nucleotide with a phosphorothioate linkage to the neighboring nucleotide
  modified_base (2)..(2): 2'-O-methyl modified nucleotide with phosphodiester linkages to neighboring nucleotides
  modified_base (3)..(3): 2'-O-methyl modified nucleotide with phosphodiester linkages to neighboring nucleotides
  modified_base (4)..(4): 2'-O-methyl modified nucleotide with phosphodiester linkages to neighboring nucleotides
  modified_base (5)..(5): 2'-O-methyl modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'-O-methyl modified nucleotide with phosphodiester linkages to neighboring nucleotides
  modified_base (8)..(8): 2'- fluoro modified nucleotide with phosphodiester linkages to neighboring nucleotides
  modified_base (9)..(9): 2'- fluoro modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'- fluoro modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'-O-methyl modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with phosphodiester linkages to neighboring nucleotides
  modified_base (21)..(21): 2'-O-methyl modified nucleotide with phosphodiester linkages to neighboring nucleotides
  modified_base (22)..(22): 2'-O-methyl modified nucleotide with phosphodiester linkages to neighboring nucleotides
  modified_base (23)..(23): 2'-O-methyl modified nucleotide with phosphodiester linkages to neighboring nucleotides
  modified_base (24)..(24): 2'-O-methyl modified nucleotide with phosphodiester linkages to neighboring nucleotides
  modified_base (25)..(25): 2'-O-methyl modified nucleotide with phosphodiester linkages to neighboring nucleotides
  modified_base (26)..(26): 2'-O-methyl modified nucleotide with phosphodiester linkages to neighboring nucleotides
  modified_base (27)..(27): 2'-O-methyl modified nucleotide with phosphodiester linkages to neighboring nucleotides
  modified_base (28)..(28): GalNAc attached to an adenine nucleotide
  modified_base (29)..(29): GalNAc attached to an adenine nucleotide
  modified_base (30)..(30): GalNAc attached to an adenine nucleotide
  modified_base (31)..(31): 2'-O-methyl modified nucleotide with phosphodiester linkages to neighboring nucleotides
  modified_base (32)..(32): 2'-O-methyl modified nucleotide with phosphodiester linkages to neighboring nucleotides
  modified_base (33)..(33): 2'-O-methyl modified nucleotide with phosphodiester linkages to neighboring nucleotides
  modified_base (34)..(34): 2'-O-methyl modified nucleotide with phosphodiester linkages to neighboring nucleotides
  modified_base (35)..(35): 2'-O-methyl modified nucleotide with phosphodiester linkages to neighboring nucleotides
  modified_base (36)..(36): 2'-O-methyl modified nucleotide

SEQ ID NO: 1619 - RNA, 36 nt, Artificial Sequence; identical to SEQ ID NO: 1547
  Description of Artificial Sequence: Synthetic oligonucleotide
  modified_base (1)..(1): 2'-O-methyl modified nucleotide with a phosphorothioate linkage to the neighboring nucleotide
  modified_base (2)..(2): 2'-O-methyl modified nucleotide with phosphodiester linkages to neighboring nucleotides
  modified_base (3)..(3): 2'-O-methyl modified nucleotide with phosphodiester linkages to neighboring nucleotides
  modified_base (4)..(4): 2'-O-methyl modified nucleotide with phosphodiester linkages to neighboring nucleotides
  modified_base (5)..(5): 2'-O-methyl modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'-O-methyl modified nucleotide with phosphodiester linkages to neighboring nucleotides
  modified_base (8)..(8): 2'- fluoro modified nucleotide with phosphodiester linkages to neighboring nucleotides
  modified_base (9)..(9): 2'- fluoro modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'- fluoro modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'-O-methyl modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with phosphodiester linkages to neighboring nucleotides
  modified_base (21)..(21): 2'-O-methyl modified nucleotide with phosphodiester linkages to neighboring nucleotides
  modified_base (22)..(22): 2'-O-methyl modified nucleotide with phosphodiester linkages to neighboring nucleotides
  modified_base (23)..(23): 2'-O-methyl modified nucleotide with phosphodiester linkages to neighboring nucleotides
  modified_base (24)..(24): 2'-O-methyl modified nucleotide with phosphodiester linkages to neighboring nucleotides
  modified_base (25)..(25): 2'-O-methyl modified nucleotide with phosphodiester linkages to neighboring nucleotides
  modified_base (26)..(26): 2'-O-methyl modified nucleotide with phosphodiester linkages to neighboring nucleotides
  modified_base (27)..(27): 2'-O-methyl modified nucleotide with phosphodiester linkages to neighboring nucleotides
  modified_base (28)..(28): GalNAc attached to an adenine nucleotide
  modified_base (29)..(29): GalNAc attached to an adenine nucleotide
  modified_base (30)..(30): GalNAc attached to an adenine nucleotide
  modified_base (31)..(31): 2'-O-methyl modified nucleotide with phosphodiester linkages to neighboring nucleotides
  modified_base (32)..(32): 2'-O-methyl modified nucleotide with phosphodiester linkages to neighboring nucleotides
  modified_base (33)..(33): 2'-O-methyl modified nucleotide with phosphodiester linkages to neighboring nucleotides
  modified_base (34)..(34): 2'-O-methyl modified nucleotide with phosphodiester linkages to neighboring nucleotides
  modified_base (35)..(35): 2'-O-methyl modified nucleotide with phosphodiester linkages to neighboring nucleotides
  modified_base (36)..(36): 2'-O-methyl modified nucleotide

SEQ ID NO: 1620 - RNA, 36 nt, Artificial Sequence; identical to SEQ ID NO: 1548
  Description of Artificial Sequence: Synthetic oligonucleotide
  modified_base (1)..(1): 2'-O-methyl modified nucleotide with a phosphorothioate linkage to the neighboring nucleotide
  modified_base (2)..(2): 2'-O-methyl modified nucleotide with phosphodiester linkages to neighboring nucleotides
  modified_base (3)..(3): 2'-O-methyl modified nucleotide with phosphodiester linkages to neighboring nucleotides
  modified_base (4)..(4): 2'-O-methyl modified nucleotide with phosphodiester linkages to neighboring nucleotides
  modified_base (5)..(5): 2'-O-methyl modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'-O-methyl modified nucleotide with phosphodiester linkages to neighboring nucleotides
  modified_base (8)..(8): 2'- fluoro modified nucleotide with phosphodiester linkages to neighboring nucleotides
  modified_base (9)..(9): 2'- fluoro modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'- fluoro modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'-O-methyl modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with phosphodiester linkages to neighboring nucleotides
  modified_base (21)..(21): 2'-O-methyl modified nucleotide with phosphodiester linkages to neighboring nucleotides
  modified_base (22)..(22): 2'-O-methyl modified nucleotide with phosphodiester linkages to neighboring nucleotides
  modified_base (23)..(23): 2'-O-methyl modified nucleotide with phosphodiester linkages to neighboring nucleotides
  modified_base (24)..(24): 2'-O-methyl modified nucleotide with phosphodiester linkages to neighboring nucleotides
  modified_base (25)..(25): 2'-O-methyl modified nucleotide with phosphodiester linkages to neighboring nucleotides
  modified_base (26)..(26): 2'-O-methyl modified nucleotide with phosphodiester linkages to neighboring nucleotides
  modified_base (27)..(27): 2'-O-methyl modified nucleotide with phosphodiester linkages to neighboring nucleotides
  modified_base (28)..(28): GalNAc attached to an adenine nucleotide
  modified_base (29)..(29): GalNAc attached to an adenine nucleotide
  modified_base (30)..(30): GalNAc attached to an adenine nucleotide
  modified_base (31)..(31): 2'-O-methyl modified nucleotide with phosphodiester linkages to neighboring nucleotides
  modified_base (32)..(32): 2'-O-methyl modified nucleotide with phosphodiester linkages to neighboring nucleotides
  modified_base (33)..(33): 2'-O-methyl modified nucleotide with phosphodiester linkages to neighboring nucleotides
  modified_base (34)..(34): 2'-O-methyl modified nucleotide with phosphodiester linkages to neighboring nucleotides
  modified_base (35)..(35): 2'-O-methyl modified nucleotide with phosphodiester linkages to neighboring nucleotides
  modified_base (36)..(36): 2'-O-methyl modified nucleotide

SEQ ID NO: 1621 - RNA, 36 nt, Artificial Sequence; identical to SEQ ID NO: 1549
  Description of Artificial Sequence: Synthetic oligonucleotide
  modified_base (1)..(1): 2'-O-methyl modified nucleotide with a phosphorothioate linkage to the neighboring nucleotide
  modified_base (2)..(2): 2'-O-methyl modified nucleotide with phosphodiester linkages to neighboring nucleotides
  modified_base (3)..(3): 2'-O-methyl modified nucleotide with phosphodiester linkages to neighboring nucleotides
  modified_base (4)..(4): 2'-O-methyl modified nucleotide with phosphodiester linkages to neighboring nucleotides
  modified_base (5)..(5): 2'-O-methyl modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'-O-methyl modified nucleotide with phosphodiester linkages to neighboring nucleotides
  modified_base (8)..(8): 2'- fluoro modified nucleotide with phosphodiester linkages to neighboring nucleotides
  modified_base (9)..(9): 2'- fluoro modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'- fluoro modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'-O-methyl modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with phosphodiester linkages to neighboring nucleotides
  modified_base (21)..(21): 2'-O-methyl modified nucleotide with phosphodiester linkages to neighboring nucleotides
  modified_base (22)..(22): 2'-O-methyl modified nucleotide with phosphodiester linkages to neighboring nucleotides
  modified_base (23)..(23): 2'-O-methyl modified nucleotide with phosphodiester linkages to neighboring nucleotides
  modified_base (24)..(24): 2'-O-methyl modified nucleotide with phosphodiester linkages to neighboring nucleotides
  modified_base (25)..(25): 2'-O-methyl modified nucleotide with phosphodiester linkages to neighboring nucleotides
  modified_base (26)..(26): 2'-O-methyl modified nucleotide with phosphodiester linkages to neighboring nucleotides
  modified_base (27)..(27): 2'-O-methyl modified nucleotide with phosphodiester linkages to neighboring nucleotides
  modified_base (28)..(28): GalNAc attached to an adenine nucleotide
  modified_base (29)..(29): GalNAc attached to an adenine nucleotide
  modified_base (30)..(30): GalNAc attached to an adenine nucleotide
  modified_base (31)..(31): 2'-O-methyl modified nucleotide with phosphodiester linkages to neighboring nucleotides
  modified_base (32)..(32): 2'-O-methyl modified nucleotide with phosphodiester linkages to neighboring nucleotides
  modified_base (33)..(33): 2'-O-methyl modified nucleotide with phosphodiester linkages to neighboring nucleotides
  modified_base (34)..(34): 2'-O-methyl modified nucleotide with phosphodiester linkages to neighboring nucleotides
  modified_base (35)..(35): 2'-O-methyl modified nucleotide with phosphodiester linkages to neighboring nucleotides
  modified_base (36)..(36): 2'-O-methyl modified nucleotide

SEQ ID NO: 1622 - RNA, 36 nt, Artificial Sequence; identical to SEQ ID NO: 1550
  Description of Artificial Sequence: Synthetic oligonucleotide
  modified_base (1)..(1): 2'-O-methyl modified nucleotide with a phosphorothioate linkage to the neighboring nucleotide
  modified_base (2)..(2): 2'-O-methyl modified nucleotide with phosphodiester linkages to neighboring nucleotides
  modified_base (3)..(3): 2'-O-methyl modified nucleotide with phosphodiester linkages to neighboring nucleotides
  modified_base (4)..(4): 2'-O-methyl modified nucleotide with phosphodiester linkages to neighboring nucleotides
  modified_base (5)..(5): 2'-O-methyl modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'-O-methyl modified nucleotide with phosphodiester linkages to neighboring nucleotides
  modified_base (8)..(8): 2'- fluoro modified nucleotide with phosphodiester linkages to neighboring nucleotides
  modified_base (9)..(9): 2'- fluoro modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'- fluoro modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'-O-methyl modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with phosphodiester linkages to neighboring nucleotides
  modified_base (21)..(21): 2'-O-methyl modified nucleotide with phosphodiester linkages to neighboring nucleotides
  modified_base (22)..(22): 2'-O-methyl modified nucleotide with phosphodiester linkages to neighboring nucleotides
  modified_base (23)..(23): 2'-O-methyl modified nucleotide with phosphodiester linkages to neighboring nucleotides
  modified_base (24)..(24): 2'-O-methyl modified nucleotide with phosphodiester linkages to neighboring nucleotides
  modified_base (25)..(25): 2'-O-methyl modified nucleotide with phosphodiester linkages to neighboring nucleotides
  modified_base (26)..(26): 2'-O-methyl modified nucleotide with phosphodiester linkages to neighboring nucleotides
  modified_base (27)..(27): 2'-O-methyl modified nucleotide with phosphodiester linkages to neighboring nucleotides
  modified_base (28)..(28): GalNAc attached to an adenine nucleotide
  modified_base (29)..(29): GalNAc attached to an adenine nucleotide
  modified_base (30)..(30): GalNAc attached to an adenine nucleotide
  modified_base (31)..(31): 2'-O-methyl modified nucleotide with phosphodiester linkages to neighboring nucleotides
  modified_base (32)..(32): 2'-O-methyl modified nucleotide with phosphodiester linkages to neighboring nucleotides
  modified_base (33)..(33): 2'-O-methyl modified nucleotide with phosphodiester linkages to neighboring nucleotides
  modified_base (34)..(34): 2'-O-methyl modified nucleotide with phosphodiester linkages to neighboring nucleotides
  modified_base (35)..(35): 2'-O-methyl modified nucleotide with phosphodiester linkages to neighboring nucleotides
  modified_base (36)..(36): 2'-O-methyl modified nucleotide

SEQ ID NO: 1623 - RNA, 36 nt, Artificial Sequence; identical to SEQ ID NO: 1551
  Description of Artificial Sequence: Synthetic oligonucleotide
  modified_base (1)..(1): 2'-O-methyl modified nucleotide with a phosphorothioate linkage to the neighboring nucleotide
  modified_base (2)..(2): 2'-O-methyl modified nucleotide with phosphodiester linkages to neighboring nucleotides
  modified_base (3)..(3): 2'-O-methyl modified nucleotide with phosphodiester linkages to neighboring nucleotides
  modified_base (4)..(4): 2'-O-methyl modified nucleotide with phosphodiester linkages to neighboring nucleotides
  modified_base (5)..(5): 2'-O-methyl modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'-O-methyl modified nucleotide with phosphodiester linkages to neighboring nucleotides
  modified_base (8)..(8): 2'- fluoro modified nucleotide with phosphodiester linkages to neighboring nucleotides
  modified_base (9)..(9): 2'- fluoro modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'- fluoro modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'-O-methyl modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with phosphodiester linkages to neighboring nucleotides
  modified_base (21)..(21): 2'-O-methyl modified nucleotide with phosphodiester linkages to neighboring nucleotides
  modified_base (22)..(22): 2'-O-methyl modified nucleotide with phosphodiester linkages to neighboring nucleotides
  modified_base (23)..(23): 2'-O-methyl modified nucleotide with phosphodiester linkages to neighboring nucleotides
  modified_base (24)..(24): 2'-O-methyl modified nucleotide with phosphodiester linkages to neighboring nucleotides
  modified_base (25)..(25): 2'-O-methyl modified nucleotide with phosphodiester linkages to neighboring nucleotides
  modified_base (26)..(26): 2'-O-methyl modified nucleotide with phosphodiester linkages to neighboring nucleotides
  modified_base (27)..(27): 2'-O-methyl modified nucleotide with phosphodiester linkages to neighboring nucleotides
  modified_base (28)..(28): GalNAc attached to an adenine nucleotide
  modified_base (29)..(29): GalNAc attached to an adenine nucleotide
  modified_base (30)..(30): GalNAc attached to an adenine nucleotide
  modified_base (31)..(31): 2'-O-methyl modified nucleotide with phosphodiester linkages to neighboring nucleotides
  modified_base (32)..(32): 2'-O-methyl modified nucleotide with phosphodiester linkages to neighboring nucleotides
  modified_base (33)..(33): 2'-O-methyl modified nucleotide with phosphodiester linkages to neighboring nucleotides
  modified_base (34)..(34): 2'-O-methyl modified nucleotide with phosphodiester linkages to neighboring nucleotides
  modified_base (35)..(35): 2'-O-methyl modified nucleotide with phosphodiester linkages to neighboring nucleotides
  modified_base (36)..(36): 2'-O-methyl modified nucleotide

SEQ ID NO: 1624 - RNA, 36 nt, Artificial Sequence; identical to SEQ ID NO: 1552
  Description of Artificial Sequence: Synthetic oligonucleotide
  modified_base (1)..(1): 2'-O-methyl modified nucleotide with a phosphorothioate linkage to the neighboring nucleotide
  modified_base (2)..(2): 2'-O-methyl modified nucleotide with phosphodiester linkages to neighboring nucleotides
  modified_base (3)..(3): 2'-O-methyl modified nucleotide with phosphodiester linkages to neighboring nucleotides
  modified_base (4)..(4): 2'-O-methyl modified nucleotide with phosphodiester linkages to neighboring nucleotides
  modified_base (5)..(5): 2'-O-methyl modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'-O-methyl modified nucleotide with phosphodiester linkages to neighboring nucleotides
  modified_base (8)..(8): 2'- fluoro modified nucleotide with phosphodiester linkages to neighboring nucleotides
  modified_base (9)..(9): 2'- fluoro modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'- fluoro modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'-O-methyl modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with phosphodiester linkages to neighboring nucleotides
  modified_base (21)..(21): 2'-O-methyl modified nucleotide with phosphodiester linkages to neighboring nucleotides
  modified_base (22)..(22): 2'-O-methyl modified nucleotide with phosphodiester linkages to neighboring nucleotides
  modified_base (23)..(23): 2'-O-methyl modified nucleotide with phosphodiester linkages to neighboring nucleotides
  modified_base (24)..(24): 2'-O-methyl modified nucleotide with phosphodiester linkages to neighboring nucleotides
  modified_base (25)..(25): 2'-O-methyl modified nucleotide with phosphodiester linkages to neighboring nucleotides
  modified_base (26)..(26): 2'-O-methyl modified nucleotide with phosphodiester linkages to neighboring nucleotides
  modified_base (27)..(27): 2'-O-methyl modified nucleotide with phosphodiester linkages to neighboring nucleotides
  modified_base (28)..(28): GalNAc attached to an adenine nucleotide
  modified_base (29)..(29): GalNAc attached to an adenine nucleotide
  modified_base (30)..(30): GalNAc attached to an adenine nucleotide
  modified_base (31)..(31): 2'-O-methyl modified nucleotide with phosphodiester linkages to neighboring nucleotides
  modified_base (32)..(32): 2'-O-methyl modified nucleotide with phosphodiester linkages to neighboring nucleotides
  modified_base (33)..(33): 2'-O-methyl modified nucleotide with phosphodiester linkages to neighboring nucleotides
  modified_base (34)..(34): 2'-O-methyl modified nucleotide with phosphodiester linkages to neighboring nucleotides
  modified_base (35)..(35): 2'-O-methyl modified nucleotide with phosphodiester linkages to neighboring nucleotides
  modified_base (36)..(36): 2'-O-methyl modified nucleotide

SEQ ID NO: 1625 - RNA, 36 nt, Artificial Sequence; identical to SEQ ID NO: 1553
  Description of Artificial Sequence: Synthetic oligonucleotide
  modified_base (1)..(1): 2'-O-methyl modified nucleotide with a phosphorothioate linkage to the neighboring nucleotide
  modified_base (2)..(2): 2'-O-methyl modified nucleotide with phosphodiester linkages to neighboring nucleotides
  modified_base (3)..(3): 2'-O-methyl modified nucleotide with phosphodiester linkages to neighboring nucleotides
  modified_base (4)..(4): 2'-O-methyl modified nucleotide with phosphodiester linkages to neighboring nucleotides
  modified_base (5)..(5): 2'-O-methyl modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'-O-methyl modified nucleotide with phosphodiester linkages to neighboring nucleotides
  modified_base (8)..(8): 2'- fluoro modified nucleotide with phosphodiester linkages to neighboring nucleotides
  modified_base (9)..(9): 2'- fluoro modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'- fluoro modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'-O-methyl modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with phosphodiester linkages to neighboring nucleotides
  modified_base (21)..(21): 2'-O-methyl modified nucleotide with phosphodiester linkages to neighboring nucleotides
  modified_base (22)..(22): 2'-O-methyl modified nucleotide with phosphodiester linkages to neighboring nucleotides
  modified_base (23)..(23): 2'-O-methyl modified nucleotide with phosphodiester linkages to neighboring nucleotides
  modified_base (24)..(24): 2'-O-methyl modified nucleotide with phosphodiester linkages to neighboring nucleotides
  modified_base (25)..(25): 2'-O-methyl modified nucleotide with phosphodiester linkages to neighboring nucleotides
  modified_base (26)..(26): 2'-O-methyl modified nucleotide with phosphodiester linkages to neighboring nucleotides
  modified_base (27)..(27): 2'-O-methyl modified nucleotide with phosphodiester linkages to neighboring nucleotides
  modified_base (28)..(28): GalNAc attached to an adenine nucleotide
  modified_base (29)..(29): GalNAc attached to an adenine nucleotide
  modified_base (30)..(30): GalNAc attached to an adenine nucleotide
  modified_base (31)..(31): 2'-O-methyl modified nucleotide with phosphodiester linkages to neighboring nucleotides
  modified_base (32)..(32): 2'-O-methyl modified nucleotide with phosphodiester linkages to neighboring nucleotides
  modified_base (33)..(33): 2'-O-methyl modified nucleotide with phosphodiester linkages to neighboring nucleotides
  modified_base (34)..(34): 2'-O-methyl modified nucleotide with phosphodiester linkages to neighboring nucleotides
  modified_base (35)..(35): 2'-O-methyl modified nucleotide with phosphodiester linkages to neighboring nucleotides
  modified_base (36)..(36): 2'-O-methyl modified nucleotide

SEQ ID NO: 1626 - RNA, 36 nt, Artificial Sequence; identical to SEQ ID NO: 1554
  Description of Artificial Sequence: Synthetic oligonucleotide
  modified_base (1)..(1): 2'-O-methyl modified nucleotide with a phosphorothioate linkage to the neighboring nucleotide
  modified_base (2)..(2): 2'-O-methyl modified nucleotide with phosphodiester linkages to neighboring nucleotides
  modified_base (3)..(3): 2'-O-methyl modified nucleotide with phosphodiester linkages to neighboring nucleotides
  modified_base (4)..(4): 2'-O-methyl modified nucleotide with phosphodiester linkages to neighboring nucleotides
  modified_base (5)..(5): 2'-O-methyl modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'-O-methyl modified nucleotide with phosphodiester linkages to neighboring nucleotides
  modified_base (8)..(8): 2'- fluoro modified nucleotide with phosphodiester linkages to neighboring nucleotides
  modified_base (9)..(9): 2'- fluoro modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'- fluoro modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'-O-methyl modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with phosphodiester linkages to neighboring nucleotides
  modified_base (21)..(21): 2'-O-methyl modified nucleotide with phosphodiester linkages to neighboring nucleotides
  modified_base (22)..(22): 2'-O-methyl modified nucleotide with phosphodiester linkages to neighboring nucleotides
  modified_base (23)..(23): 2'-O-methyl modified nucleotide with phosphodiester linkages to neighboring nucleotides
  modified_base (24)..(24): 2'-O-methyl modified nucleotide with phosphodiester linkages to neighboring nucleotides
  modified_base (25)..(25): 2'-O-methyl modified nucleotide with phosphodiester linkages to neighboring nucleotides
  modified_base (26)..(26): 2'-O-methyl modified nucleotide with phosphodiester linkages to neighboring nucleotides
  modified_base (27)..(27): 2'-O-methyl modified nucleotide with phosphodiester linkages to neighboring nucleotides
  modified_base (28)..(28): GalNAc attached to an adenine nucleotide
  modified_base (29)..(29): GalNAc attached to an adenine nucleotide
  modified_base (30)..(30): GalNAc attached to an adenine nucleotide
  modified_base (31)..(31): 2'-O-methyl modified nucleotide with phosphodiester linkages to neighboring nucleotides
  modified_base (32)..(32): 2'-O-methyl modified nucleotide with phosphodiester linkages to neighboring nucleotides
  modified_base (33)..(33): 2'-O-methyl modified nucleotide with phosphodiester linkages to neighboring nucleotides
  modified_base (34)..(34): 2'-O-methyl modified nucleotide with phosphodiester linkages to neighboring nucleotides
  modified_base (35)..(35): 2'-O-methyl modified nucleotide with phosphodiester linkages to neighboring nucleotides
  modified_base (36)..(36): 2'-O-methyl modified nucleotide

SEQ ID NO: 1627 - RNA, 36 nt, Artificial Sequence; identical to SEQ ID NO: 1555
  Description of Artificial Sequence: Synthetic oligonucleotide
  modified_base (1)..(1): 2'-O-methyl modified nucleotide with a phosphorothioate linkage to the neighboring nucleotide
  modified_base (2)..(2): 2'-O-methyl modified nucleotide with phosphodiester linkages to neighboring nucleotides
  modified_base (3)..(3): 2'-O-methyl modified nucleotide with phosphodiester linkages to neighboring nucleotides
  modified_base (4)..(4): 2'-O-methyl modified nucleotide with phosphodiester linkages to neighboring nucleotides
  modified_base (5)..(5): 2'-O-methyl modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'-O-methyl modified nucleotide with phosphodiester linkages to neighboring nucleotides
  modified_base (8)..(8): 2'- fluoro modified nucleotide with phosphodiester linkages to neighboring nucleotides
  modified_base (9)..(9): 2'- fluoro modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'- fluoro modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'-O-methyl modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with phosphodiester linkages to neighboring nucleotides
  modified_base (21)..(21): 2'-O-methyl modified nucleotide with phosphodiester linkages to neighboring nucleotides
  modified_base (22)..(22): 2'-O-methyl modified nucleotide with phosphodiester linkages to neighboring nucleotides
  modified_base (23)..(23): 2'-O-methyl modified nucleotide with phosphodiester linkages to neighboring nucleotides
  modified_base (24)..(24): 2'-O-methyl modified nucleotide with phosphodiester linkages to neighboring nucleotides
  modified_base (25)..(25): 2'-O-methyl modified nucleotide with phosphodiester linkages to neighboring nucleotides
  modified_base (26)..(26): 2'-O-methyl modified nucleotide with phosphodiester linkages to neighboring nucleotides
  modified_base (27)..(27): 2'-O-methyl modified nucleotide with phosphodiester linkages to neighboring nucleotides
  modified_base (28)..(28): GalNAc attached to an adenine nucleotide
  modified_base (29)..(29): GalNAc attached to an adenine nucleotide
  modified_base (30)..(30): GalNAc attached to an adenine nucleotide
  modified_base (31)..(31): 2'-O-methyl modified nucleotide with phosphodiester linkages to neighboring nucleotides
  modified_base (32)..(32): 2'-O-methyl modified nucleotide with phosphodiester linkages to neighboring nucleotides
  modified_base (33)..(33): 2'-O-methyl modified nucleotide with phosphodiester linkages to neighboring nucleotides
  modified_base (34)..(34): 2'-O-methyl modified nucleotide with phosphodiester linkages to neighboring nucleotides
  modified_base (35)..(35): 2'-O-methyl modified nucleotide with phosphodiester linkages to neighboring nucleotides
  modified_base (36)..(36): 2'-O-methyl modified nucleotide

SEQ ID NO: 1628 - RNA, 36 nt, Artificial Sequence; identical to SEQ ID NO: 1556
  Description of Artificial Sequence: Synthetic oligonucleotide
  modified_base (1)..(1): 2'-O-methyl modified nucleotide with a phosphorothioate linkage to the neighboring nucleotide
  modified_base (2)..(2): 2'-O-methyl modified nucleotide with phosphodiester linkages to neighboring nucleotides
  modified_base (3)..(3): 2'-O-methyl modified nucleotide with phosphodiester linkages to neighboring nucleotides
  modified_base (4)..(4): 2'-O-methyl modified nucleotide with phosphodiester linkages to neighboring nucleotides
  modified_base (5)..(5): 2'-O-methyl modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'-O-methyl modified nucleotide with phosphodiester linkages to neighboring nucleotides
  modified_base (8)..(8): 2'- fluoro modified nucleotide with phosphodiester linkages to neighboring nucleotides
  modified_base (9)..(9): 2'- fluoro modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'- fluoro modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'-O-methyl modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with phosphodiester linkages to neighboring nucleotides
  modified_base (21)..(21): 2'-O-methyl modified nucleotide with phosphodiester linkages to neighboring nucleotides
  modified_base (22)..(22): 2'-O-methyl modified nucleotide with phosphodiester linkages to neighboring nucleotides
  modified_base (23)..(23): 2'-O-methyl modified nucleotide with phosphodiester linkages to neighboring nucleotides
  modified_base (24)..(24): 2'-O-methyl modified nucleotide with phosphodiester linkages to neighboring nucleotides
  modified_base (25)..(25): 2'-O-methyl modified nucleotide with phosphodiester linkages to neighboring nucleotides
  modified_base (26)..(26): 2'-O-methyl modified nucleotide with phosphodiester linkages to neighboring nucleotides
  modified_base (27)..(27): 2'-O-methyl modified nucleotide with phosphodiester linkages to neighboring nucleotides
  modified_base (28)..(28): GalNAc attached to an adenine nucleotide
  modified_base (29)..(29): GalNAc attached to an adenine nucleotide
  modified_base (30)..(30): GalNAc attached to an adenine nucleotide
  modified_base (31)..(31): 2'-O-methyl modified nucleotide with phosphodiester linkages to neighboring nucleotides
  modified_base (32)..(32): 2'-O-methyl modified nucleotide with phosphodiester linkages to neighboring nucleotides
  modified_base (33)..(33): 2'-O-methyl modified nucleotide with phosphodiester linkages to neighboring nucleotides
  modified_base (34)..(34): 2'-O-methyl modified nucleotide with phosphodiester linkages to neighboring nucleotides
  modified_base (35)..(35): 2'-O-methyl modified nucleotide with phosphodiester linkages to neighboring nucleotides
  modified_base (36)..(36): 2'-O-methyl modified nucleotide

SEQ ID NO: 1629 - RNA, 36 nt, Artificial Sequence; identical to SEQ ID NO: 1557
  Description of Artificial Sequence: Synthetic oligonucleotide
  modified_base (1)..(1): 2'-O-methyl modified nucleotide with a phosphorothioate linkage to the neighboring nucleotide
  modified_base (2)..(2): 2'-O-methyl modified nucleotide with phosphodiester linkages to neighboring nucleotides
  modified_base (3)..(3): 2'-O-methyl modified nucleotide with phosphodiester linkages to neighboring nucleotides
  modified_base (4)..(4): 2'-O-methyl modified nucleotide with phosphodiester linkages to neighboring nucleotides
  modified_base (5)..(5): 2'-O-methyl modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'-O-methyl modified nucleotide with phosphodiester linkages to neighboring nucleotides
  modified_base (8)..(8): 2'- fluoro modified nucleotide with phosphodiester linkages to neighboring nucleotides
  modified_base (9)..(9): 2'- fluoro modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'- fluoro modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'-O-methyl modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with phosphodiester linkages to neighboring nucleotides
  modified_base (21)..(21): 2'-O-methyl modified nucleotide with phosphodiester linkages to neighboring nucleotides
  modified_base (22)..(22): 2'-O-methyl modified nucleotide with phosphodiester linkages to neighboring nucleotides
  modified_base (23)..(23): 2'-O-methyl modified nucleotide with phosphodiester linkages to neighboring nucleotides
  modified_base (24)..(24): 2'-O-methyl modified nucleotide with phosphodiester linkages to neighboring nucleotides
  modified_base (25)..(25): 2'-O-methyl modified nucleotide with phosphodiester linkages to neighboring nucleotides
  modified_base (26)..(26): 2'-O-methyl modified nucleotide with phosphodiester linkages to neighboring nucleotides
  modified_base (27)..(27): 2'-O-methyl modified nucleotide with phosphodiester linkages to neighboring nucleotides
  modified_base (28)..(28): GalNAc attached to an adenine nucleotide
  modified_base (29)..(29): GalNAc attached to an adenine nucleotide
  modified_base (30)..(30): GalNAc attached to an adenine nucleotide
  modified_base (31)..(31): 2'-O-methyl modified nucleotide with phosphodiester linkages to neighboring nucleotides
  modified_base (32)..(32): 2'-O-methyl modified nucleotide with phosphodiester linkages to neighboring nucleotides
  modified_base (33)..(33): 2'-O-methyl modified nucleotide with phosphodiester linkages to neighboring nucleotides
  modified_base (34)..(34): 2'-O-methyl modified nucleotide with phosphodiester linkages to neighboring nucleotides
  modified_base (35)..(35): 2'-O-methyl modified nucleotide with phosphodiester linkages to neighboring nucleotides
  modified_base (36)..(36): 2'-O-methyl modified nucleotide

SEQ ID NO: 1630 - RNA, 36 nt, Artificial Sequence; identical to SEQ ID NO: 1558
  Description of Artificial Sequence: Synthetic oligonucleotide
  modified_base (1)..(1): 2'-O-methyl modified nucleotide with a phosphorothioate linkage to the neighboring nucleotide
  modified_base (2)..(2): 2'-O-methyl modified nucleotide with phosphodiester linkages to neighboring nucleotides
  modified_base (3)..(3): 2'-O-methyl modified nucleotide with phosphodiester linkages to neighboring nucleotides
  modified_base (4)..(4): 2'-O-methyl modified nucleotide with phosphodiester linkages to neighboring nucleotides
  modified_base (5)..(5): 2'-O-methyl modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'-O-methyl modified nucleotide with phosphodiester linkages to neighboring nucleotides
  modified_base (8)..(8): 2'- fluoro modified nucleotide with phosphodiester linkages to neighboring nucleotides
  modified_base (9)..(9): 2'- fluoro modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'- fluoro modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'-O-methyl modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with phosphodiester linkages to neighboring nucleotides
  modified_base (21)..(21): 2'-O-methyl modified nucleotide with phosphodiester linkages to neighboring nucleotides
  modified_base (22)..(22): 2'-O-methyl modified nucleotide with phosphodiester linkages to neighboring nucleotides
  modified_base (23)..(23): 2'-O-methyl modified nucleotide with phosphodiester linkages to neighboring nucleotides
  modified_base (24)..(24): 2'-O-methyl modified nucleotide with phosphodiester linkages to neighboring nucleotides
  modified_base (25)..(25): 2'-O-methyl modified nucleotide with phosphodiester linkages to neighboring nucleotides
  modified_base (26)..(26): 2'-O-methyl modified nucleotide with phosphodiester linkages to neighboring nucleotides
  modified_base (27)..(27): 2'-O-methyl modified nucleotide with phosphodiester linkages to neighboring nucleotides
  modified_base (28)..(28): GalNAc attached to an adenine nucleotide
  modified_base (29)..(29): GalNAc attached to an adenine nucleotide
  modified_base (30)..(30): GalNAc attached to an adenine nucleotide
  modified_base (31)..(31): 2'-O-methyl modified nucleotide with phosphodiester linkages to neighboring nucleotides
  modified_base (32)..(32): 2'-O-methyl modified nucleotide with phosphodiester linkages to neighboring nucleotides
  modified_base (33)..(33): 2'-O-methyl modified nucleotide with phosphodiester linkages to neighboring nucleotides
  modified_base (34)..(34): 2'-O-methyl modified nucleotide with phosphodiester linkages to neighboring nucleotides
  modified_base (35)..(35): 2'-O-methyl modified nucleotide with phosphodiester linkages to neighboring nucleotides
  modified_base (36)..(36): 2'-O-methyl modified nucleotide

SEQ ID NO: 1631 - RNA, 36 nt, Artificial Sequence; identical to SEQ ID NO: 1559
  Description of Artificial Sequence: Synthetic oligonucleotide
  modified_base (1)..(1): 2'-O-methyl modified nucleotide with a phosphorothioate linkage to the neighboring nucleotide
  modified_base (2)..(2): 2'-O-methyl modified nucleotide with phosphodiester linkages to neighboring nucleotides
  modified_base (3)..(3): 2'-O-methyl modified nucleotide with phosphodiester linkages to neighboring nucleotides
  modified_base (4)..(4): 2'-O-methyl modified nucleotide with phosphodiester linkages to neighboring nucleotides
  modified_base (5)..(5): 2'-O-methyl modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'-O-methyl modified nucleotide with phosphodiester linkages to neighboring nucleotides
  modified_base (8)..(8): 2'- fluoro modified nucleotide with phosphodiester linkages to neighboring nucleotides
  modified_base (9)..(9): 2'- fluoro modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'- fluoro modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'-O-methyl modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with phosphodiester linkages to neighboring nucleotides
  modified_base (21)..(21): 2'-O-methyl modified nucleotide with phosphodiester linkages to neighboring nucleotides
  modified_base (22)..(22): 2'-O-methyl modified nucleotide with phosphodiester linkages to neighboring nucleotides
  modified_base (23)..(23): 2'-O-methyl modified nucleotide with phosphodiester linkages to neighboring nucleotides
  modified_base (24)..(24): 2'-O-methyl modified nucleotide with phosphodiester linkages to neighboring nucleotides
  modified_base (25)..(25): 2'-O-methyl modified nucleotide with phosphodiester linkages to neighboring nucleotides
  modified_base (26)..(26): 2'-O-methyl modified nucleotide with phosphodiester linkages to neighboring nucleotides
  modified_base (27)..(27): 2'-O-methyl modified nucleotide with phosphodiester linkages to neighboring nucleotides
  modified_base (28)..(28): GalNAc attached to an adenine nucleotide
  modified_base (29)..(29): GalNAc attached to an adenine nucleotide
  modified_base (30)..(30): GalNAc attached to an adenine nucleotide
  modified_base (31)..(31): 2'-O-methyl modified nucleotide with phosphodiester linkages to neighboring nucleotides
  modified_base (32)..(32): 2'-O-methyl modified nucleotide with phosphodiester linkages to neighboring nucleotides
  modified_base (33)..(33): 2'-O-methyl modified nucleotide with phosphodiester linkages to neighboring nucleotides
  modified_base (34)..(34): 2'-O-methyl modified nucleotide with phosphodiester linkages to neighboring nucleotides
  modified_base (35)..(35): 2'-O-methyl modified nucleotide with phosphodiester linkages to neighboring nucleotides
  modified_base (36)..(36): 2'-O-methyl modified nucleotide

SEQ ID NO: 1632 - RNA, 36 nt, Artificial Sequence; identical to SEQ ID NO: 1560
  Description of Artificial Sequence: Synthetic oligonucleotide
  modified_base (1)..(1): 2'-O-methyl modified nucleotide with a phosphorothioate linkage to the neighboring nucleotide
  modified_base (2)..(2): 2'-O-methyl modified nucleotide with phosphodiester linkages to neighboring nucleotides
  modified_base (3)..(3): 2'-O-methyl modified nucleotide with phosphodiester linkages to neighboring nucleotides
  modified_base (4)..(4): 2'-O-methyl modified nucleotide with phosphodiester linkages to neighboring nucleotides
  modified_base (5)..(5): 2'-O-methyl modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'-O-methyl modified nucleotide with phosphodiester linkages to neighboring nucleotides
  modified_base (8)..(8): 2'- fluoro modified nucleotide with phosphodiester linkages to neighboring nucleotides
  modified_base (9)..(9): 2'- fluoro modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'- fluoro modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'-O-methyl modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with phosphodiester linkages to neighboring nucleotides
  modified_base (21)..(21): 2'-O-methyl modified nucleotide with phosphodiester linkages to neighboring nucleotides
  modified_base (22)..(22): 2'-O-methyl modified nucleotide with phosphodiester linkages to neighboring nucleotides
  modified_base (23)..(23): 2'-O-methyl modified nucleotide with phosphodiester linkages to neighboring nucleotides
  modified_base (24)..(24): 2'-O-methyl modified nucleotide with phosphodiester linkages to neighboring nucleotides
  modified_base (25)..(25): 2'-O-methyl modified nucleotide with phosphodiester linkages to neighboring nucleotides
  modified_base (26)..(26): 2'-O-methyl modified nucleotide with phosphodiester linkages to neighboring nucleotides
  modified_base (27)..(27): 2'-O-methyl modified nucleotide with phosphodiester linkages to neighboring nucleotides
  modified_base (28)..(28): GalNAc attached to an adenine nucleotide
  modified_base (29)..(29): GalNAc attached to an adenine nucleotide
  modified_base (30)..(30): GalNAc attached to an adenine nucleotide
  modified_base (31)..(31): 2'-O-methyl modified nucleotide with phosphodiester linkages to neighboring nucleotides
  modified_base (32)..(32): 2'-O-methyl modified nucleotide with phosphodiester linkages to neighboring nucleotides
  modified_base (33)..(33): 2'-O-methyl modified nucleotide with phosphodiester linkages to neighboring nucleotides
  modified_base (34)..(34): 2'-O-methyl modified nucleotide with phosphodiester linkages to neighboring nucleotides
  modified_base (35)..(35): 2'-O-methyl modified nucleotide with phosphodiester linkages to neighboring nucleotides
  modified_base (36)..(36): 2'-O-methyl modified nucleotide

SEQ ID NO: 1633 - RNA, 36 nt, Artificial Sequence; identical to SEQ ID NO: 1561
  Description of Artificial Sequence: Synthetic oligonucleotide
  modified_base (1)..(1): 2'-O-methyl modified nucleotide with a phosphorothioate linkage to the neighboring nucleotide
  modified_base (2)..(2): 2'-O-methyl modified nucleotide with phosphodiester linkages to neighboring nucleotides
  modified_base (3)..(3): 2'-O-methyl modified nucleotide with phosphodiester linkages to neighboring nucleotides
  modified_base (4)..(4): 2'-O-methyl modified nucleotide with phosphodiester linkages to neighboring nucleotides
  modified_base (5)..(5): 2'-O-methyl modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'-O-methyl modified nucleotide with phosphodiester linkages to neighboring nucleotides
  modified_base (8)..(8): 2'- fluoro modified nucleotide with phosphodiester linkages to neighboring nucleotides
  modified_base (9)..(9): 2'- fluoro modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'- fluoro modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'-O-methyl modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with phosphodiester linkages to neighboring nucleotides
  modified_base (21)..(21): 2'-O-methyl modified nucleotide with phosphodiester linkages to neighboring nucleotides
  modified_base (22)..(22): 2'-O-methyl modified nucleotide with phosphodiester linkages to neighboring nucleotides
  modified_base (23)..(23): 2'-O-methyl modified nucleotide with phosphodiester linkages to neighboring nucleotides
  modified_base (24)..(24): 2'-O-methyl modified nucleotide with phosphodiester linkages to neighboring nucleotides
  modified_base (25)..(25): 2'-O-methyl modified nucleotide with phosphodiester linkages to neighboring nucleotides
  modified_base (26)..(26): 2'-O-methyl modified nucleotide with phosphodiester linkages to neighboring nucleotides
  modified_base (27)..(27): 2'-O-methyl modified nucleotide with phosphodiester linkages to neighboring nucleotides
  modified_base (28)..(28): GalNAc attached to an adenine nucleotide
  modified_base (29)..(29): GalNAc attached to an adenine nucleotide
  modified_base (30)..(30): GalNAc attached to an adenine nucleotide
  modified_base (31)..(31): 2'-O-methyl modified nucleotide with phosphodiester linkages to neighboring nucleotides
  modified_base (32)..(32): 2'-O-methyl modified nucleotide with phosphodiester linkages to neighboring nucleotides
  modified_base (33)..(33): 2'-O-methyl modified nucleotide with phosphodiester linkages to neighboring nucleotides
  modified_base (34)..(34): 2'-O-methyl modified nucleotide with phosphodiester linkages to neighboring nucleotides
  modified_base (35)..(35): 2'-O-methyl modified nucleotide with phosphodiester linkages to neighboring nucleotides
  modified_base (36)..(36): 2'-O-methyl modified nucleotide

SEQ ID NO: 1634 - RNA, 36 nt, Artificial Sequence; identical to SEQ ID NO: 1562
  Description of Artificial Sequence: Synthetic oligonucleotide
  modified_base (1)..(1): 2'-O-methyl modified nucleotide with a phosphorothioate linkage to the neighboring nucleotide
  modified_base (2)..(2): 2'-O-methyl modified nucleotide with phosphodiester linkages to neighboring nucleotides
  modified_base (3)..(3): 2'-O-methyl modified nucleotide with phosphodiester linkages to neighboring nucleotides
  modified_base (4)..(4): 2'-O-methyl modified nucleotide with phosphodiester linkages to neighboring nucleotides
  modified_base (5)..(5): 2'-O-methyl modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'-O-methyl modified nucleotide with phosphodiester linkages to neighboring nucleotides
  modified_base (8)..(8): 2'- fluoro modified nucleotide with phosphodiester linkages to neighboring nucleotides
  modified_base (9)..(9): 2'- fluoro modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'- fluoro modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'-O-methyl modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with phosphodiester linkages to neighboring nucleotides
  modified_base (21)..(21): 2'-O-methyl modified nucleotide with phosphodiester linkages to neighboring nucleotides
  modified_base (22)..(22): 2'-O-methyl modified nucleotide with phosphodiester linkages to neighboring nucleotides
  modified_base (23)..(23): 2'-O-methyl modified nucleotide with phosphodiester linkages to neighboring nucleotides
  modified_base (24)..(24): 2'-O-methyl modified nucleotide with phosphodiester linkages to neighboring nucleotides
  modified_base (25)..(25): 2'-O-methyl modified nucleotide with phosphodiester linkages to neighboring nucleotides
  modified_base (26)..(26): 2'-O-methyl modified nucleotide with phosphodiester linkages to neighboring nucleotides
  modified_base (27)..(27): 2'-O-methyl modified nucleotide with phosphodiester linkages to neighboring nucleotides
  modified_base (28)..(28): GalNAc attached to an adenine nucleotide
  modified_base (29)..(29): GalNAc attached to an adenine nucleotide
  modified_base (30)..(30): GalNAc attached to an adenine nucleotide
  modified_base (31)..(31): 2'-O-methyl modified nucleotide with phosphodiester linkages to neighboring nucleotides
  modified_base (32)..(32): 2'-O-methyl modified nucleotide with phosphodiester linkages to neighboring nucleotides
  modified_base (33)..(33): 2'-O-methyl modified nucleotide with phosphodiester linkages to neighboring nucleotides
  modified_base (34)..(34): 2'-O-methyl modified nucleotide with phosphodiester linkages to neighboring nucleotides
  modified_base (35)..(35): 2'-O-methyl modified nucleotide with phosphodiester linkages to neighboring nucleotides
  modified_base (36)..(36): 2'-O-methyl modified nucleotide

SEQ ID NO: 1635 - RNA, 36 nt, Artificial Sequence; identical to SEQ ID NO: 1563
  Description of Artificial Sequence: Synthetic oligonucleotide
  modified_base (1)..(1): 2'-O-methyl modified nucleotide with a phosphorothioate linkage to the neighboring nucleotide
  modified_base (2)..(2): 2'-O-methyl modified nucleotide with phosphodiester linkages to neighboring nucleotides
  modified_base (3)..(3): 2'-O-methyl modified nucleotide with phosphodiester linkages to neighboring nucleotides
  modified_base (4)..(4): 2'-O-methyl modified nucleotide with phosphodiester linkages to neighboring nucleotides
  modified_base (5)..(5): 2'-O-methyl modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'-O-methyl modified nucleotide with phosphodiester linkages to neighboring nucleotides
  modified_base (8)..(8): 2'- fluoro modified nucleotide with phosphodiester linkages to neighboring nucleotides
  modified_base (9)..(9): 2'- fluoro modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'- fluoro modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'-O-methyl modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with phosphodiester linkages to neighboring nucleotides
  modified_base (21)..(21): 2'-O-methyl modified nucleotide with phosphodiester linkages to neighboring nucleotides
  modified_base (22)..(22): 2'-O-methyl modified nucleotide with phosphodiester linkages to neighboring nucleotides
  modified_base (23)..(23): 2'-O-methyl modified nucleotide with phosphodiester linkages to neighboring nucleotides
  modified_base (24)..(24): 2'-O-methyl modified nucleotide with phosphodiester linkages to neighboring nucleotides
  modified_base (25)..(25): 2'-O-methyl modified nucleotide with phosphodiester linkages to neighboring nucleotides
  modified_base (26)..(26): 2'-O-methyl modified nucleotide with phosphodiester linkages to neighboring nucleotides
  modified_base (27)..(27): 2'-O-methyl modified nucleotide with phosphodiester linkages to neighboring nucleotides
  modified_base (28)..(28): GalNAc attached to an adenine nucleotide
  modified_base (29)..(29): GalNAc attached to an adenine nucleotide
  modified_base (30)..(30): GalNAc attached to an adenine nucleotide
  modified_base (31)..(31): 2'-O-methyl modified nucleotide with phosphodiester linkages to neighboring nucleotides
  modified_base (32)..(32): 2'-O-methyl modified nucleotide with phosphodiester linkages to neighboring nucleotides
  modified_base (33)..(33): 2'-O-methyl modified nucleotide with phosphodiester linkages to neighboring nucleotides
  modified_base (34)..(34): 2'-O-methyl modified nucleotide with phosphodiester linkages to neighboring nucleotides
  modified_base (35)..(35): 2'-O-methyl modified nucleotide with phosphodiester linkages to neighboring nucleotides
  modified_base (36)..(36): 2'-O-methyl modified nucleotide

SEQ ID NO: 1636 - RNA, 36 nt, Artificial Sequence; identical to SEQ ID NO: 1564
  Description of Artificial Sequence: Synthetic oligonucleotide
  modified_base (1)..(1): 2'-O-methyl modified nucleotide with a phosphorothioate linkage to the neighboring nucleotide
  modified_base (2)..(2): 2'-O-methyl modified nucleotide with phosphodiester linkages to neighboring nucleotides
  modified_base (3)..(3): 2'-O-methyl modified nucleotide with phosphodiester linkages to neighboring nucleotides
  modified_base (4)..(4): 2'-O-methyl modified nucleotide with phosphodiester linkages to neighboring nucleotides
  modified_base (5)..(5): 2'-O-methyl modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'-O-methyl modified nucleotide with phosphodiester linkages to neighboring nucleotides
  modified_base (8)..(8): 2'- fluoro modified nucleotide with phosphodiester linkages to neighboring nucleotides
  modified_base (9)..(9): 2'- fluoro modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'- fluoro modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'-O-methyl modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with phosphodiester linkages to neighboring nucleotides
  modified_base (21)..(21): 2'-O-methyl modified nucleotide with phosphodiester linkages to neighboring nucleotides
  modified_base (22)..(22): 2'-O-methyl modified nucleotide with phosphodiester linkages to neighboring nucleotides
  modified_base (23)..(23): 2'-O-methyl modified nucleotide with phosphodiester linkages to neighboring nucleotides
  modified_base (24)..(24): 2'-O-methyl modified nucleotide with phosphodiester linkages to neighboring nucleotides
  modified_base (25)..(25): 2'-O-methyl modified nucleotide with phosphodiester linkages to neighboring nucleotides
  modified_base (26)..(26): 2'-O-methyl modified nucleotide with phosphodiester linkages to neighboring nucleotides
  modified_base (27)..(27): 2'-O-methyl modified nucleotide with phosphodiester linkages to neighboring nucleotides
  modified_base (28)..(28): GalNAc attached to an adenine nucleotide
  modified_base (29)..(29): GalNAc attached to an adenine nucleotide
  modified_base (30)..(30): GalNAc attached to an adenine nucleotide
  modified_base (31)..(31): 2'-O-methyl modified nucleotide with phosphodiester linkages to neighboring nucleotides
  modified_base (32)..(32): 2'-O-methyl modified nucleotide with phosphodiester linkages to neighboring nucleotides
  modified_base (33)..(33): 2'-O-methyl modified nucleotide with phosphodiester linkages to neighboring nucleotides
  modified_base (34)..(34): 2'-O-methyl modified nucleotide with phosphodiester linkages to neighboring nucleotides
  modified_base (35)..(35): 2'-O-methyl modified nucleotide with phosphodiester linkages to neighboring nucleotides
  modified_base (36)..(36): 2'-O-methyl modified nucleotide

SEQ ID NO: 1637 - RNA, 36 nt, Artificial Sequence; identical to SEQ ID NO: 1565
  Description of Artificial Sequence: Synthetic oligonucleotide
  modified_base (1)..(1): 2'-O-methyl modified nucleotide with a phosphorothioate linkage to the neighboring nucleotide
  modified_base (2)..(2): 2'-O-methyl modified nucleotide with phosphodiester linkages to neighboring nucleotides
  modified_base (3)..(3): 2'-O-methyl modified nucleotide with phosphodiester linkages to neighboring nucleotides
  modified_base (4)..(4): 2'-O-methyl modified nucleotide with phosphodiester linkages to neighboring nucleotides
  modified_base (5)..(5): 2'-O-methyl modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'-O-methyl modified nucleotide with phosphodiester linkages to neighboring nucleotides
  modified_base (8)..(8): 2'- fluoro modified nucleotide with phosphodiester linkages to neighboring nucleotides
  modified_base (9)..(9): 2'- fluoro modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'- fluoro modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'-O-methyl modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with phosphodiester linkages to neighboring nucleotides
  modified_base (21)..(21): 2'-O-methyl modified nucleotide with phosphodiester linkages to neighboring nucleotides
  modified_base (22)..(22): 2'-O-methyl modified nucleotide with phosphodiester linkages to neighboring nucleotides
  modified_base (23)..(23): 2'-O-methyl modified nucleotide with phosphodiester linkages to neighboring nucleotides
  modified_base (24)..(24): 2'-O-methyl modified nucleotide with phosphodiester linkages to neighboring nucleotides
  modified_base (25)..(25): 2'-O-methyl modified nucleotide with phosphodiester linkages to neighboring nucleotides
  modified_base (26)..(26): 2'-O-methyl modified nucleotide with phosphodiester linkages to neighboring nucleotides
  modified_base (27)..(27): 2'-O-methyl modified nucleotide with phosphodiester linkages to neighboring nucleotides
  modified_base (28)..(28): GalNAc attached to an adenine nucleotide
  modified_base (29)..(29): GalNAc attached to an adenine nucleotide
  modified_base (30)..(30): GalNAc attached to an adenine nucleotide
  modified_base (31)..(31): 2'-O-methyl modified nucleotide with phosphodiester linkages to neighboring nucleotides
  modified_base (32)..(32): 2'-O-methyl modified nucleotide with phosphodiester linkages to neighboring nucleotides
  modified_base (33)..(33): 2'-O-methyl modified nucleotide with phosphodiester linkages to neighboring nucleotides
  modified_base (34)..(34): 2'-O-methyl modified nucleotide with phosphodiester linkages to neighboring nucleotides
  modified_base (35)..(35): 2'-O-methyl modified nucleotide with phosphodiester linkages to neighboring nucleotides
  modified_base (36)..(36): 2'-O-methyl modified nucleotide

SEQ ID NO: 1638 - RNA, 36 nt, Artificial Sequence; identical to SEQ ID NO: 1566
  Description of Artificial Sequence: Synthetic oligonucleotide
  modified_base (1)..(1): 2'-O-methyl modified nucleotide with a phosphorothioate linkage to the neighboring nucleotide
  modified_base (2)..(2): 2'-O-methyl modified nucleotide with phosphodiester linkages to neighboring nucleotides
  modified_base (3)..(3): 2'-O-methyl modified nucleotide with phosphodiester linkages to neighboring nucleotides
  modified_base (4)..(4): 2'-O-methyl modified nucleotide with phosphodiester linkages to neighboring nucleotides
  modified_base (5)..(5): 2'-O-methyl modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'-O-methyl modified nucleotide with phosphodiester linkages to neighboring nucleotides
  modified_base (8)..(8): 2'- fluoro modified nucleotide with phosphodiester linkages to neighboring nucleotides
  modified_base (9)..(9): 2'- fluoro modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'- fluoro modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'-O-methyl modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with phosphodiester linkages to neighboring nucleotides
  modified_base (21)..(21): 2'-O-methyl modified nucleotide with phosphodiester linkages to neighboring nucleotides
  modified_base (22)..(22): 2'-O-methyl modified nucleotide with phosphodiester linkages to neighboring nucleotides
  modified_base (23)..(23): 2'-O-methyl modified nucleotide with phosphodiester linkages to neighboring nucleotides
  modified_base (24)..(24): 2'-O-methyl modified nucleotide with phosphodiester linkages to neighboring nucleotides
  modified_base (25)..(25): 2'-O-methyl modified nucleotide with phosphodiester linkages to neighboring nucleotides
  modified_base (26)..(26): 2'-O-methyl modified nucleotide with phosphodiester linkages to neighboring nucleotides
  modified_base (27)..(27): 2'-O-methyl modified nucleotide with phosphodiester linkages to neighboring nucleotides
  modified_base (28)..(28): GalNAc attached to an adenine nucleotide
  modified_base (29)..(29): GalNAc attached to an adenine nucleotide
  modified_base (30)..(30): GalNAc attached to an adenine nucleotide
  modified_base (31)..(31): 2'-O-methyl modified nucleotide with phosphodiester linkages to neighboring nucleotides
  modified_base (32)..(32): 2'-O-methyl modified nucleotide with phosphodiester linkages to neighboring nucleotides
  modified_base (33)..(33): 2'-O-methyl modified nucleotide with phosphodiester linkages to neighboring nucleotides
  modified_base (34)..(34): 2'-O-methyl modified nucleotide with phosphodiester linkages to neighboring nucleotides
  modified_base (35)..(35): 2'-O-methyl modified nucleotide with phosphodiester linkages to neighboring nucleotides
  modified_base (36)..(36): 2'-O-methyl modified nucleotide

SEQ ID NO: 1639 - RNA, 36 nt, Artificial Sequence; identical to SEQ ID NO: 1567
  Description of Artificial Sequence: Synthetic oligonucleotide
  modified_base (1)..(1): 2'-O-methyl modified nucleotide with a phosphorothioate linkage to the neighboring nucleotide
  modified_base (2)..(2): 2'-O-methyl modified nucleotide with phosphodiester linkages to neighboring nucleotides
  modified_base (3)..(3): 2'-O-methyl modified nucleotide with phosphodiester linkages to neighboring nucleotides
  modified_base (4)..(4): 2'-O-methyl modified nucleotide with phosphodiester linkages to neighboring nucleotides
  modified_base (5)..(5): 2'-O-methyl modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'-O-methyl modified nucleotide with phosphodiester linkages to neighboring nucleotides
  modified_base (8)..(8): 2'- fluoro modified nucleotide with phosphodiester linkages to neighboring nucleotides
  modified_base (9)..(9): 2'- fluoro modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'- fluoro modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'-O-methyl modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with phosphodiester linkages to neighboring nucleotides
  modified_base (21)..(21): 2'-O-methyl modified nucleotide with phosphodiester linkages to neighboring nucleotides
  modified_base (22)..(22): 2'-O-methyl modified nucleotide with phosphodiester linkages to neighboring nucleotides
  modified_base (23)..(23): 2'-O-methyl modified nucleotide with phosphodiester linkages to neighboring nucleotides
  modified_base (24)..(24): 2'-O-methyl modified nucleotide with phosphodiester linkages to neighboring nucleotides
  modified_base (25)..(25): 2'-O-methyl modified nucleotide with phosphodiester linkages to neighboring nucleotides
  modified_base (26)..(26): 2'-O-methyl modified nucleotide with phosphodiester linkages to neighboring nucleotides
  modified_base (27)..(27): 2'-O-methyl modified nucleotide with phosphodiester linkages to neighboring nucleotides
  modified_base (28)..(28): GalNAc attached to an adenine nucleotide
  modified_base (29)..(29): GalNAc attached to an adenine nucleotide
  modified_base (30)..(30): GalNAc attached to an adenine nucleotide
  modified_base (31)..(31): 2'-O-methyl modified nucleotide with phosphodiester linkages to neighboring nucleotides
  modified_base (32)..(32): 2'-O-methyl modified nucleotide with phosphodiester linkages to neighboring nucleotides
  modified_base (33)..(33): 2'-O-methyl modified nucleotide with phosphodiester linkages to neighboring nucleotides
  modified_base (34)..(34): 2'-O-methyl modified nucleotide with phosphodiester linkages to neighboring nucleotides
  modified_base (35)..(35): 2'-O-methyl modified nucleotide with phosphodiester linkages to neighboring nucleotides
  modified_base (36)..(36): 2'-O-methyl modified nucleotide

SEQ ID NO: 1640 - RNA, 36 nt, Artificial Sequence; identical to SEQ ID NO: 1568
  Description of Artificial Sequence: Synthetic oligonucleotide
  modified_base (1)..(1): 2'-O-methyl modified nucleotide with a phosphorothioate linkage to the neighboring nucleotide
  modified_base (2)..(2): 2'-O-methyl modified nucleotide with phosphodiester linkages to neighboring nucleotides
  modified_base (3)..(3): 2'-O-methyl modified nucleotide with phosphodiester linkages to neighboring nucleotides
  modified_base (4)..(4): 2'-O-methyl modified nucleotide with phosphodiester linkages to neighboring nucleotides
  modified_base (5)..(5): 2'-O-methyl modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'-O-methyl modified nucleotide with phosphodiester linkages to neighboring nucleotides
  modified_base (8)..(8): 2'- fluoro modified nucleotide with phosphodiester linkages to neighboring nucleotides
  modified_base (9)..(9): 2'- fluoro modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'- fluoro modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'-O-methyl modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with phosphodiester linkages to neighboring nucleotides
  modified_base (21)..(21): 2'-O-methyl modified nucleotide with phosphodiester linkages to neighboring nucleotides
  modified_base (22)..(22): 2'-O-methyl modified nucleotide with phosphodiester linkages to neighboring nucleotides
  modified_base (23)..(23): 2'-O-methyl modified nucleotide with phosphodiester linkages to neighboring nucleotides
  modified_base (24)..(24): 2'-O-methyl modified nucleotide with phosphodiester linkages to neighboring nucleotides
  modified_base (25)..(25): 2'-O-methyl modified nucleotide with phosphodiester linkages to neighboring nucleotides
  modified_base (26)..(26): 2'-O-methyl modified nucleotide with phosphodiester linkages to neighboring nucleotides
  modified_base (27)..(27): 2'-O-methyl modified nucleotide with phosphodiester linkages to neighboring nucleotides
  modified_base (28)..(28): GalNAc attached to an adenine nucleotide
  modified_base (29)..(29): GalNAc attached to an adenine nucleotide
  modified_base (30)..(30): GalNAc attached to an adenine nucleotide
  modified_base (31)..(31): 2'-O-methyl modified nucleotide with phosphodiester linkages to neighboring nucleotides
  modified_base (32)..(32): 2'-O-methyl modified nucleotide with phosphodiester linkages to neighboring nucleotides
  modified_base (33)..(33): 2'-O-methyl modified nucleotide with phosphodiester linkages to neighboring nucleotides
  modified_base (34)..(34): 2'-O-methyl modified nucleotide with phosphodiester linkages to neighboring nucleotides
  modified_base (35)..(35): 2'-O-methyl modified nucleotide with phosphodiester linkages to neighboring nucleotides
  modified_base (36)..(36): 2'-O-methyl modified nucleotide

SEQ ID NO: 1641 - RNA, 36 nt, Artificial Sequence; identical to SEQ ID NO: 1569
  Description of Artificial Sequence: Synthetic oligonucleotide
  modified_base (1)..(1): 2'-O-methyl modified nucleotide with a phosphorothioate linkage to the neighboring nucleotide
  modified_base (2)..(2): 2'-O-methyl modified nucleotide with phosphodiester linkages to neighboring nucleotides
  modified_base (3)..(3): 2'-O-methyl modified nucleotide with phosphodiester linkages to neighboring nucleotides
  modified_base (4)..(4): 2'-O-methyl modified nucleotide with phosphodiester linkages to neighboring nucleotides
  modified_base (5)..(5): 2'-O-methyl modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'-O-methyl modified nucleotide with phosphodiester linkages to neighboring nucleotides
  modified_base (8)..(8): 2'- fluoro modified nucleotide with phosphodiester linkages to neighboring nucleotides
  modified_base (9)..(9): 2'- fluoro modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'- fluoro modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'-O-methyl modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with phosphodiester linkages to neighboring nucleotides
  modified_base (21)..(21): 2'-O-methyl modified nucleotide with phosphodiester linkages to neighboring nucleotides
  modified_base (22)..(22): 2'-O-methyl modified nucleotide with phosphodiester linkages to neighboring nucleotides
  modified_base (23)..(23): 2'-O-methyl modified nucleotide with phosphodiester linkages to neighboring nucleotides
  modified_base (24)..(24): 2'-O-methyl modified nucleotide with phosphodiester linkages to neighboring nucleotides
  modified_base (25)..(25): 2'-O-methyl modified nucleotide with phosphodiester linkages to neighboring nucleotides
  modified_base (26)..(26): 2'-O-methyl modified nucleotide with phosphodiester linkages to neighboring nucleotides
  modified_base (27)..(27): 2'-O-methyl modified nucleotide with phosphodiester linkages to neighboring nucleotides
  modified_base (28)..(28): GalNAc attached to an adenine nucleotide
  modified_base (29)..(29): GalNAc attached to an adenine nucleotide
  modified_base (30)..(30): GalNAc attached to an adenine nucleotide
  modified_base (31)..(31): 2'-O-methyl modified nucleotide with phosphodiester linkages to neighboring nucleotides
  modified_base (32)..(32): 2'-O-methyl modified nucleotide with phosphodiester linkages to neighboring nucleotides
  modified_base (33)..(33): 2'-O-methyl modified nucleotide with phosphodiester linkages to neighboring nucleotides
  modified_base (34)..(34): 2'-O-methyl modified nucleotide with phosphodiester linkages to neighboring nucleotides
  modified_base (35)..(35): 2'-O-methyl modified nucleotide with phosphodiester linkages to neighboring nucleotides
  modified_base (36)..(36): 2'-O-methyl modified nucleotide

SEQ ID NO: 1642 - RNA, 36 nt, Artificial Sequence; identical to SEQ ID NO: 1570
  Description of Artificial Sequence: Synthetic oligonucleotide
  modified_base (1)..(1): 2'-O-methyl modified nucleotide with a phosphorothioate linkage to the neighboring nucleotide
  modified_base (2)..(2): 2'-O-methyl modified nucleotide with phosphodiester linkages to neighboring nucleotides
  modified_base (3)..(3): 2'-O-methyl modified nucleotide with phosphodiester linkages to neighboring nucleotides
  modified_base (4)..(4): 2'-O-methyl modified nucleotide with phosphodiester linkages to neighboring nucleotides
  modified_base (5)..(5): 2'-O-methyl modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'-O-methyl modified nucleotide with phosphodiester linkages to neighboring nucleotides
  modified_base (8)..(8): 2'- fluoro modified nucleotide with phosphodiester linkages to neighboring nucleotides
  modified_base (9)..(9): 2'- fluoro modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'- fluoro modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'-O-methyl modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with phosphodiester linkages to neighboring nucleotides
  modified_base (21)..(21): 2'-O-methyl modified nucleotide with phosphodiester linkages to neighboring nucleotides
  modified_base (22)..(22): 2'-O-methyl modified nucleotide with phosphodiester linkages to neighboring nucleotides
  modified_base (23)..(23): 2'-O-methyl modified nucleotide with phosphodiester linkages to neighboring nucleotides
  modified_base (24)..(24): 2'-O-methyl modified nucleotide with phosphodiester linkages to neighboring nucleotides
  modified_base (25)..(25): 2'-O-methyl modified nucleotide with phosphodiester linkages to neighboring nucleotides
  modified_base (26)..(26): 2'-O-methyl modified nucleotide with phosphodiester linkages to neighboring nucleotides
  modified_base (27)..(27): 2'-O-methyl modified nucleotide with phosphodiester linkages to neighboring nucleotides
  modified_base (28)..(28): GalNAc attached to an adenine nucleotide
  modified_base (29)..(29): GalNAc attached to an adenine nucleotide
  modified_base (30)..(30): GalNAc attached to an adenine nucleotide
  modified_base (31)..(31): 2'-O-methyl modified nucleotide with phosphodiester linkages to neighboring nucleotides
  modified_base (32)..(32): 2'-O-methyl modified nucleotide with phosphodiester linkages to neighboring nucleotides
  modified_base (33)..(33): 2'-O-methyl modified nucleotide with phosphodiester linkages to neighboring nucleotides
  modified_base (34)..(34): 2'-O-methyl modified nucleotide with phosphodiester linkages to neighboring nucleotides
  modified_base (35)..(35): 2'-O-methyl modified nucleotide with phosphodiester linkages to neighboring nucleotides
  modified_base (36)..(36): 2'-O-methyl modified nucleotide

SEQ ID NO: 1643 - RNA, 36 nt, Artificial Sequence; identical to SEQ ID NO: 1571
  Description of Artificial Sequence: Synthetic oligonucleotide
  modified_base (1)..(1): 2'-O-methyl modified nucleotide with a phosphorothioate linkage to the neighboring nucleotide
  modified_base (2)..(2): 2'-O-methyl modified nucleotide with phosphodiester linkages to neighboring nucleotides
  modified_base (3)..(3): 2'-O-methyl modified nucleotide with phosphodiester linkages to neighboring nucleotides
  modified_base (4)..(4): 2'-O-methyl modified nucleotide with phosphodiester linkages to neighboring nucleotides
  modified_base (5)..(5): 2'-O-methyl modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'-O-methyl modified nucleotide with phosphodiester linkages to neighboring nucleotides
  modified_base (8)..(8): 2'- fluoro modified nucleotide with phosphodiester linkages to neighboring nucleotides
  modified_base (9)..(9): 2'- fluoro modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'- fluoro modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'-O-methyl modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with phosphodiester linkages to neighboring nucleotides
  modified_base (21)..(21): 2'-O-methyl modified nucleotide with phosphodiester linkages to neighboring nucleotides
  modified_base (22)..(22): 2'-O-methyl modified nucleotide with phosphodiester linkages to neighboring nucleotides
  modified_base (23)..(23): 2'-O-methyl modified nucleotide with phosphodiester linkages to neighboring nucleotides
  modified_base (24)..(24): 2'-O-methyl modified nucleotide with phosphodiester linkages to neighboring nucleotides
  modified_base (25)..(25): 2'-O-methyl modified nucleotide with phosphodiester linkages to neighboring nucleotides
  modified_base (26)..(26): 2'-O-methyl modified nucleotide with phosphodiester linkages to neighboring nucleotides
  modified_base (27)..(27): 2'-O-methyl modified nucleotide with phosphodiester linkages to neighboring nucleotides
  modified_base (28)..(28): GalNAc attached to an adenine nucleotide
  modified_base (29)..(29): GalNAc attached to an adenine nucleotide
  modified_base (30)..(30): GalNAc attached to an adenine nucleotide
  modified_base (31)..(31): 2'-O-methyl modified nucleotide with phosphodiester linkages to neighboring nucleotides
  modified_base (32)..(32): 2'-O-methyl modified nucleotide with phosphodiester linkages to neighboring nucleotides
  modified_base (33)..(33): 2'-O-methyl modified nucleotide with phosphodiester linkages to neighboring nucleotides
  modified_base (34)..(34): 2'-O-methyl modified nucleotide with phosphodiester linkages to neighboring nucleotides
  modified_base (35)..(35): 2'-O-methyl modified nucleotide with phosphodiester linkages to neighboring nucleotides
  modified_base (36)..(36): 2'-O-methyl modified nucleotide

SEQ ID NO: 1644 - RNA, 36 nt, Artificial Sequence; identical to SEQ ID NO: 1572
  Description of Artificial Sequence: Synthetic oligonucleotide
  modified_base (1)..(1): 2'-O-methyl modified nucleotide with a phosphorothioate linkage to the neighboring nucleotide
  modified_base (2)..(2): 2'-O-methyl modified nucleotide with phosphodiester linkages to neighboring nucleotides
  modified_base (3)..(3): 2'-O-methyl modified nucleotide with phosphodiester linkages to neighboring nucleotides
  modified_base (4)..(4): 2'-O-methyl modified nucleotide with phosphodiester linkages to neighboring nucleotides
  modified_base (5)..(5): 2'-O-methyl modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'-O-methyl modified nucleotide with phosphodiester linkages to neighboring nucleotides
  modified_base (8)..(8): 2'- fluoro modified nucleotide with phosphodiester linkages to neighboring nucleotides
  modified_base (9)..(9): 2'- fluoro modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'- fluoro modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'-O-methyl modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with phosphodiester linkages to neighboring nucleotides
  modified_base (21)..(21): 2'-O-methyl modified nucleotide with phosphodiester linkages to neighboring nucleotides
  modified_base (22)..(22): 2'-O-methyl modified nucleotide with phosphodiester linkages to neighboring nucleotides
  modified_base (23)..(23): 2'-O-methyl modified nucleotide with phosphodiester linkages to neighboring nucleotides
  modified_base (24)..(24): 2'-O-methyl modified nucleotide with phosphodiester linkages to neighboring nucleotides
  modified_base (25)..(25): 2'-O-methyl modified nucleotide with phosphodiester linkages to neighboring nucleotides
  modified_base (26)..(26): 2'-O-methyl modified nucleotide with phosphodiester linkages to neighboring nucleotides
  modified_base (27)..(27): 2'-O-methyl modified nucleotide with phosphodiester linkages to neighboring nucleotides
  modified_base (28)..(28): GalNAc attached to an adenine nucleotide
  modified_base (29)..(29): GalNAc attached to an adenine nucleotide
  modified_base (30)..(30): GalNAc attached to an adenine nucleotide
  modified_base (31)..(31): 2'-O-methyl modified nucleotide with phosphodiester linkages to neighboring nucleotides
  modified_base (32)..(32): 2'-O-methyl modified nucleotide with phosphodiester linkages to neighboring nucleotides
  modified_base (33)..(33): 2'-O-methyl modified nucleotide with phosphodiester linkages to neighboring nucleotides
  modified_base (34)..(34): 2'-O-methyl modified nucleotide with phosphodiester linkages to neighboring nucleotides
  modified_base (35)..(35): 2'-O-methyl modified nucleotide with phosphodiester linkages to neighboring nucleotides
  modified_base (36)..(36): 2'-O-methyl modified nucleotide

SEQ ID NO: 1645 - RNA, 22 nt, Artificial Sequence
  Description of Artificial Sequence: Synthetic oligonucleotide
  modified_base (1)..(1): 5'-methoxyphosphonate-4'-oxy-2'-O-methyl modified nucleotide with a phosphorothioate linkage to the neighboring nucleotide
  modified_base (2)..(2): 2'- fluoro modified nucleotide with a phosphorothioate linkage to the neighboring nucleotide
  modified_base (3)..(3): 2'- fluoro modified nucleotide with a phosphorothioate linkage to the neighboring nucleotide
  modified_base (4)..(4): 2'- fluoro modified nucleotide with phosphodiester linkages to neighboring nucleotides
  modified_base (5)..(5): 2'- fluoro modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'- fluoro modified nucleotide with phosphodiester linkages to neighboring nucleotides
  modified_base (8)..(8): 2'-O-methyl modified nucleotide with phosphodiester linkages to neighboring nucleotides
  modified_base (9)..(9): 2'-O-methyl modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'-O-methyl modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'- fluoro modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with a phosphorothioate linkage to the neighboring nucleotide
  modified_base (21)..(21): 2'-O-methyl modified nucleotide with a phosphorothioate linkage to the neighboring nucleotide
  modified_base (22)..(22): 2'-O-methyl modified nucleotide
ucaagccaaaaccugucccggg

SEQ ID NO: 1646 - RNA, 22 nt, Artificial Sequence
  Description of Artificial Sequence: Synthetic oligonucleotide
  modified_base (1)..(1): 5'-methoxyphosphonate-4'-oxy-2'-O-methyl modified nucleotide with a phosphorothioate linkage to the neighboring nucleotide
  modified_base (2)..(2): 2'- fluoro modified nucleotide with a phosphorothioate linkage to the neighboring nucleotide
  modified_base (3)..(3): 2'- fluoro modified nucleotide with a phosphorothioate linkage to the neighboring nucleotide
  modified_base (4)..(4): 2'- fluoro modified nucleotide with phosphodiester linkages to neighboring nucleotides
  modified_base (5)..(5): 2'- fluoro modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'- fluoro modified nucleotide with phosphodiester linkages to neighboring nucleotides
  modified_base (8)..(8): 2'-O-methyl modified nucleotide with phosphodiester linkages to neighboring nucleotides
  modified_base (9)..(9): 2'-O-methyl modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'-O-methyl modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'- fluoro modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with a phosphorothioate linkage to the neighboring nucleotide
  modified_base (21)..(21): 2'-O-methyl modified nucleotide with a phosphorothioate linkage to the neighboring nucleotide
  modified_base (22)..(22): 2'-O-methyl modified nucleotide
ucacaagccaaaaccuguccgg

SEQ ID NO: 1647 - RNA, 22 nt, Artificial Sequence
  Description of Artificial Sequence: Synthetic oligonucleotide
  modified_base (1)..(1): 5'-methoxyphosphonate-4'-oxy-2'-O-methyl modified nucleotide with a phosphorothioate linkage to the neighboring nucleotide
  modified_base (2)..(2): 2'- fluoro modified nucleotide with a phosphorothioate linkage to the neighboring nucleotide
  modified_base (3)..(3): 2'- fluoro modified nucleotide with a phosphorothioate linkage to the neighboring nucleotide
  modified_base (4)..(4): 2'- fluoro modified nucleotide with phosphodiester linkages to neighboring nucleotides
  modified_base (5)..(5): 2'- fluoro modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'- fluoro modified nucleotide with phosphodiester linkages to neighboring nucleotides
  modified_base (8)..(8): 2'-O-methyl modified nucleotide with phosphodiester linkages to neighboring nucleotides
  modified_base (9)..(9): 2'-O-methyl modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'-O-methyl modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'- fluoro modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with a phosphorothioate linkage to the neighboring nucleotide
  modified_base (21)..(21): 2'-O-methyl modified nucleotide with a phosphorothioate linkage to the neighboring nucleotide
  modified_base (22)..(22): 2'-O-methyl modified nucleotide
uucacaagccaaaaccugucgg

SEQ ID NO: 1648 - RNA, 22 nt, Artificial Sequence
  Description of Artificial Sequence: Synthetic oligonucleotide
  modified_base (1)..(1): 5'-methoxyphosphonate-4'-oxy-2'-O-methyl modified nucleotide with a phosphorothioate linkage to the neighboring nucleotide
  modified_base (2)..(2): 2'- fluoro modified nucleotide with a phosphorothioate linkage to the neighboring nucleotide
  modified_base (3)..(3): 2'- fluoro modified nucleotide with a phosphorothioate linkage to the neighboring nucleotide
  modified_base (4)..(4): 2'- fluoro modified nucleotide with phosphodiester linkages to neighboring nucleotides
  modified_base (5)..(5): 2'- fluoro modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'- fluoro modified nucleotide with phosphodiester linkages to neighboring nucleotides
  modified_base (8)..(8): 2'-O-methyl modified nucleotide with phosphodiester linkages to neighboring nucleotides
  modified_base (9)..(9): 2'-O-methyl modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'-O-methyl modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'- fluoro modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with a phosphorothioate linkage to the neighboring nucleotide
  modified_base (21)..(21): 2'-O-methyl modified nucleotide with a phosphorothioate linkage to the neighboring nucleotide
  modified_base (22)..(22): 2'-O-methyl modified nucleotide
uugaucacaagccaaaaccugg

SEQ ID NO: 1649 - RNA, 22 nt, Artificial Sequence
  Description of Artificial Sequence: Synthetic oligonucleotide
  modified_base (1)..(1): 5'-methoxyphosphonate-4'-oxy-2'-O-methyl modified nucleotide with a phosphorothioate linkage to the neighboring nucleotide
  modified_base (2)..(2): 2'- fluoro modified nucleotide with a phosphorothioate linkage to the neighboring nucleotide
  modified_base (3)..(3): 2'- fluoro modified nucleotide with a phosphorothioate linkage to the neighboring nucleotide
  modified_base (4)..(4): 2'- fluoro modified nucleotide with phosphodiester linkages to neighboring nucleotides
  modified_base (5)..(5): 2'- fluoro modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'- fluoro modified nucleotide with phosphodiester linkages to neighboring nucleotides
  modified_base (8)..(8): 2'-O-methyl modified nucleotide with phosphodiester linkages to neighboring nucleotides
  modified_base (9)..(9): 2'-O-methyl modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'-O-methyl modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'- fluoro modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with a phosphorothioate linkage to the neighboring nucleotide
  modified_base (21)..(21): 2'-O-methyl modified nucleotide with a phosphorothioate linkage to the neighboring nucleotide
  modified_base (22)..(22): 2'-O-methyl modified nucleotide
uuugaucacaagccaaaaccgg

SEQ ID NO: 1650 - RNA, 22 nt, Artificial Sequence
  Description of Artificial Sequence: Synthetic oligonucleotide
  modified_base (1)..(1): 5'-methoxyphosphonate-4'-oxy-2'-O-methyl modified nucleotide with a phosphorothioate linkage to the neighboring nucleotide
  modified_base (2)..(2): 2'- fluoro modified nucleotide with a phosphorothioate linkage to the neighboring nucleotide
  modified_base (3)..(3): 2'- fluoro modified nucleotide with a phosphorothioate linkage to the neighboring nucleotide
  modified_base (4)..(4): 2'- fluoro modified nucleotide with phosphodiester linkages to neighboring nucleotides
  modified_base (5)..(5): 2'- fluoro modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'- fluoro modified nucleotide with phosphodiester linkages to neighboring nucleotides
  modified_base (8)..(8): 2'-O-methyl modified nucleotide with phosphodiester linkages to neighboring nucleotides
  modified_base (9)..(9): 2'-O-methyl modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'-O-methyl modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'- fluoro modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with a phosphorothioate linkage to the neighboring nucleotide
  modified_base (21)..(21): 2'-O-methyl modified nucleotide with a phosphorothioate linkage to the neighboring nucleotide
  modified_base (22)..(22): 2'-O-methyl modified nucleotide
uuaacuuucuucucuagccugg

SEQ ID NO: 1651 - RNA, 22 nt, Artificial Sequence
  Description of Artificial Sequence: Synthetic oligonucleotide
  modified_base (1)..(1): 5'-methoxyphosphonate-4'-oxy-2'-O-methyl modified nucleotide with a phosphorothioate linkage to the neighboring nucleotide
  modified_base (2)..(2): 2'- fluoro modified nucleotide with a phosphorothioate linkage to the neighboring nucleotide
  modified_base (3)..(3): 2'- fluoro modified nucleotide with a phosphorothioate linkage to the neighboring nucleotide
  modified_base (4)..(4): 2'- fluoro modified nucleotide with phosphodiester linkages to neighboring nucleotides
  modified_base (5)..(5): 2'- fluoro modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'- fluoro modified nucleotide with phosphodiester linkages to neighboring nucleotides
  modified_base (8)..(8): 2'-O-methyl modified nucleotide with phosphodiester linkages to neighboring nucleotides
  modified_base (9)..(9): 2'-O-methyl modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'-O-methyl modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'- fluoro modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with a phosphorothioate linkage to the neighboring nucleotide
  modified_base (21)..(21): 2'-O-methyl modified nucleotide with a phosphorothioate linkage to the neighboring nucleotide
  modified_base (22)..(22): 2'-O-methyl modified nucleotide
uuuaacuuucuucucuagccgg

SEQ ID NO: 1652 - RNA, 22 nt, Artificial Sequence
  Description of Artificial Sequence: Synthetic oligonucleotide
  modified_base (1)..(1): 5'-methoxyphosphonate-4'-oxy-2'-O-methyl modified nucleotide with a phosphorothioate linkage to the neighboring nucleotide
  modified_base (2)..(2): 2'- fluoro modified nucleotide with a phosphorothioate linkage to the neighboring nucleotide
  modified_base (3)..(3): 2'- fluoro modified nucleotide with a phosphorothioate linkage to the neighboring nucleotide
  modified_base (4)..(4): 2'- fluoro modified nucleotide with phosphodiester linkages to neighboring nucleotides
  modified_base (5)..(5): 2'- fluoro modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'- fluoro modified nucleotide with phosphodiester linkages to neighboring nucleotides
  modified_base (8)..(8): 2'-O-methyl modified nucleotide with phosphodiester linkages to neighboring nucleotides
  modified_base (9)..(9): 2'-O-methyl modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'-O-methyl modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'- fluoro modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with a phosphorothioate linkage to the neighboring nucleotide
  modified_base (21)..(21): 2'-O-methyl modified nucleotide with a phosphorothioate linkage to the neighboring nucleotide
  modified_base (22)..(22): 2'-O-methyl modified nucleotide
uugcauagacaucgcauccugg

SEQ ID NO: 1653 - RNA, 22 nt, Artificial Sequence
  Description of Artificial Sequence: Synthetic oligonucleotide
  modified_base (1)..(1): 5'-methoxyphosphonate-4'-oxy-2'-O-methyl modified nucleotide with a phosphorothioate linkage to the neighboring nucleotide
  modified_base (2)..(2): 2'- fluoro modified nucleotide with a phosphorothioate linkage to the neighboring nucleotide
  modified_base (3)..(3): 2'- fluoro modified nucleotide with a phosphorothioate linkage to the neighboring nucleotide
  modified_base (4)..(4): 2'- fluoro modified nucleotide with phosphodiester linkages to neighboring nucleotides
  modified_base (5)..(5): 2'- fluoro modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'- fluoro modified nucleotide with phosphodiester linkages to neighboring nucleotides
  modified_base (8)..(8): 2'-O-methyl modified nucleotide with phosphodiester linkages to neighboring nucleotides
  modified_base (9)..(9): 2'-O-methyl modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'-O-methyl modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'- fluoro modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with a phosphorothioate linkage to the neighboring nucleotide
  modified_base (21)..(21): 2'-O-methyl modified nucleotide with a phosphorothioate linkage to the neighboring nucleotide
  modified_base (22)..(22): 2'-O-methyl modified nucleotide
uuaaaaugcaucuggaacaagg

SEQ ID NO: 1654 - RNA, 22 nt, Artificial Sequence
  Description of Artificial Sequence: Synthetic oligonucleotide
  modified_base (1)..(1): 5'-methoxyphosphonate-4'-oxy-2'-O-methyl modified nucleotide with a phosphorothioate linkage to the neighboring nucleotide
  modified_base (2)..(2): 2'- fluoro modified nucleotide with a phosphorothioate linkage to the neighboring nucleotide
  modified_base (3)..(3): 2'- fluoro modified nucleotide with a phosphorothioate linkage to the neighboring nucleotide
  modified_base (4)..(4): 2'- fluoro modified nucleotide with phosphodiester linkages to neighboring nucleotides
  modified_base (5)..(5): 2'- fluoro modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'- fluoro modified nucleotide with phosphodiester linkages to neighboring nucleotides
  modified_base (8)..(8): 2'-O-methyl modified nucleotide with phosphodiester linkages to neighboring nucleotides
  modified_base (9)..(9): 2'-O-methyl modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'-O-methyl modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'- fluoro modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with a phosphorothioate linkage to the neighboring nucleotide
  modified_base (21)..(21): 2'-O-methyl modified nucleotide with a phosphorothioate linkage to the neighboring nucleotide
  modified_base (22)..(22): 2'-O-methyl modified nucleotide
uaaaaugugaaaaucacaaagg

SEQ ID NO: 1655 - RNA, 22 nt, Artificial Sequence
  Description of Artificial Sequence: Synthetic oligonucleotide
  modified_base (1)..(1): 5'-methoxyphosphonate-4'-oxy-2'-O-methyl modified nucleotide with a phosphorothioate linkage to the neighboring nucleotide
  modified_base (2)..(2): 2'- fluoro modified nucleotide with a phosphorothioate linkage to the neighboring nucleotide
  modified_base (3)..(3): 2'- fluoro modified nucleotide with a phosphorothioate linkage to the neighboring nucleotide
  modified_base (4)..(4): 2'- fluoro modified nucleotide with phosphodiester linkages to neighboring nucleotides
  modified_base (5)..(5): 2'- fluoro modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'- fluoro modified nucleotide with phosphodiester linkages to neighboring nucleotides
  modified_base (8)..(8): 2'-O-methyl modified nucleotide with phosphodiester linkages to neighboring nucleotides
  modified_base (9)..(9): 2'-O-methyl modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'-O-methyl modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'- fluoro modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with a phosphorothioate linkage to the neighboring nucleotide
  modified_base (21)..(21): 2'-O-methyl modified nucleotide with a phosphorothioate linkage to the neighboring nucleotide
  modified_base (22)..(22): 2'-O-methyl modified nucleotide
uuuccauuuauucacaguuugg

SEQ ID NO: 1656 - RNA, 22 nt, Artificial Sequence
  Description of Artificial Sequence: Synthetic oligonucleotide
  modified_base (1)..(1): 5'-methoxyphosphonate-4'-oxy-2'-O-methyl modified nucleotide with a phosphorothioate linkage to the neighboring nucleotide
  modified_base (2)..(2): 2'- fluoro modified nucleotide with a phosphorothioate linkage to the neighboring nucleotide
  modified_base (3)..(3): 2'- fluoro modified nucleotide with a phosphorothioate linkage to the neighboring nucleotide
  modified_base (4)..(4): 2'- fluoro modified nucleotide with phosphodiester linkages to neighboring nucleotides
  modified_base (5)..(5): 2'- fluoro modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'- fluoro modified nucleotide with phosphodiester linkages to neighboring nucleotides
  modified_base (8)..(8): 2'-O-methyl modified nucleotide with phosphodiester linkages to neighboring nucleotides
  modified_base (9)..(9): 2'-O-methyl modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'-O-methyl modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'- fluoro modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with a phosphorothioate linkage to the neighboring nucleotide
  modified_base (21)..(21): 2'-O-methyl modified nucleotide with a phosphorothioate linkage to the neighboring nucleotide
  modified_base (22)..(22): 2'-O-methyl modified nucleotide
ucuuccauuuauucacaguugg

SEQ ID NO: 1657 - RNA, 22 nt, Artificial Sequence
  Description of Artificial Sequence: Synthetic oligonucleotide
  modified_base (1)..(1): 5'-methoxyphosphonate-4'-oxy-2'-O-methyl modified nucleotide with a phosphorothioate linkage to the neighboring nucleotide
  modified_base (2)..(2): 2'- fluoro modified nucleotide with a phosphorothioate linkage to the neighboring nucleotide
  modified_base (3)..(3): 2'- fluoro modified nucleotide with a phosphorothioate linkage to the neighboring nucleotide
  modified_base (4)..(4): 2'- fluoro modified nucleotide with phosphodiester linkages to neighboring nucleotides
  modified_base (5)..(5): 2'- fluoro modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'- fluoro modified nucleotide with phosphodiester linkages to neighboring nucleotides
  modified_base (8)..(8): 2'-O-methyl modified nucleotide with phosphodiester linkages to neighboring nucleotides
  modified_base (9)..(9): 2'-O-methyl modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'-O-methyl modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'- fluoro modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with a phosphorothioate linkage to the neighboring nucleotide
  modified_base (21)..(21): 2'-O-methyl modified nucleotide with a phosphorothioate linkage to the neighboring nucleotide
  modified_base (22)..(22): 2'-O-methyl modified nucleotide
ugaguaagcaaucugguccugg

SEQ ID NO: 1658 - RNA, 22 nt, Artificial Sequence
  Description of Artificial Sequence: Synthetic oligonucleotide
  modified_base (1)..(1): 5'-methoxyphosphonate-4'-oxy-2'-O-methyl modified nucleotide with a phosphorothioate linkage to the neighboring nucleotide
  modified_base (2)..(2): 2'- fluoro modified nucleotide with a phosphorothioate linkage to the neighboring nucleotide
  modified_base (3)..(3): 2'- fluoro modified nucleotide with a phosphorothioate linkage to the neighboring nucleotide
  modified_base (4)..(4): 2'- fluoro modified nucleotide with phosphodiester linkages to neighboring nucleotides
  modified_base (5)..(5): 2'- fluoro modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'- fluoro modified nucleotide with phosphodiester linkages to neighboring nucleotides
  modified_base (8)..(8): 2'-O-methyl modified nucleotide with phosphodiester linkages to neighboring nucleotides
  modified_base (9)..(9): 2'-O-methyl modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'-O-methyl modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'- fluoro modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with a phosphorothioate linkage to the neighboring nucleotide
  modified_base (21)..(21): 2'-O-methyl modified nucleotide with a phosphorothioate linkage to the neighboring nucleotide
  modified_base (22)..(22): 2'-O-methyl modified nucleotide
uacaacugacauaugcuuucgg

SEQ ID NO: 1659 - RNA, 22 nt, Artificial Sequence
  Description of Artificial Sequence: Synthetic oligonucleotide
  modified_base (1)..(1): 5'-methoxyphosphonate-4'-oxy-2'-O-methyl modified nucleotide with a phosphorothioate linkage to the neighboring nucleotide
  modified_base (2)..(2): 2'- fluoro modified nucleotide with a phosphorothioate linkage to the neighboring nucleotide
  modified_base (3)..(3): 2'- fluoro modified nucleotide with a phosphorothioate linkage to the neighboring nucleotide
  modified_base (4)..(4): 2'- fluoro modified nucleotide with phosphodiester linkages to neighboring nucleotides
  modified_base (5)..(5): 2'- fluoro modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'- fluoro modified nucleotide with phosphodiester linkages to neighboring nucleotides
  modified_base (8)..(8): 2'-O-methyl modified nucleotide with phosphodiester linkages to neighboring nucleotides
  modified_base (9)..(9): 2'-O-methyl modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'-O-methyl modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'- fluoro modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with a phosphorothioate linkage to the neighboring nucleotide
  modified_base (21)..(21): 2'-O-methyl modified nucleotide with a phosphorothioate linkage to the neighboring nucleotide
  modified_base (22)..(22): 2'-O-methyl modified nucleotide
uguuuuaaacaacugacauagg

SEQ ID NO: 1660 - RNA, 22 nt, Artificial Sequence
  Description of Artificial Sequence: Synthetic oligonucleotide
  modified_base (1)..(1): 5'-methoxyphosphonate-4'-oxy-2'-O-methyl modified nucleotide with a phosphorothioate linkage to the neighboring nucleotide
  modified_base (2)..(2): 2'- fluoro modified nucleotide with a phosphorothioate linkage to the neighboring nucleotide
  modified_base (3)..(3): 2'- fluoro modified nucleotide with a phosphorothioate linkage to the neighboring nucleotide
  modified_base (4)..(4): 2'- fluoro modified nucleotide with phosphodiester linkages to neighboring nucleotides
  modified_base (5)..(5): 2'- fluoro modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'- fluoro modified nucleotide with phosphodiester linkages to neighboring nucleotides
  modified_base (8)..(8): 2'-O-methyl modified nucleotide with phosphodiester linkages to neighboring nucleotides
  modified_base (9)..(9): 2'-O-methyl modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'-O-methyl modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'- fluoro modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with a phosphorothioate linkage to the neighboring nucleotide
  modified_base (21)..(21): 2'-O-methyl modified nucleotide with a phosphorothioate linkage to the neighboring nucleotide
  modified_base (22)..(22): 2'-O-methyl modified nucleotide
uuagauauuggguuuuaaacgg

SEQ ID NO: 1661 - RNA, 22 nt, Artificial Sequence
  Description of Artificial Sequence: Synthetic oligonucleotide
  modified_base (1)..(1): 5'-methoxyphosphonate-4'-oxy-2'-O-methyl modified nucleotide with a phosphorothioate linkage to the neighboring nucleotide
  modified_base (2)..(2): 2'- fluoro modified nucleotide with a phosphorothioate linkage to the neighboring nucleotide
  modified_base (3)..(3): 2'- fluoro modified nucleotide with a phosphorothioate linkage to the neighboring nucleotide
  modified_base (4)..(4): 2'- fluoro modified nucleotide with phosphodiester linkages to neighboring nucleotides
  modified_base (5)..(5): 2'- fluoro modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'- fluoro modified nucleotide with phosphodiester linkages to neighboring nucleotides
  modified_base (8)..(8): 2'-O-methyl modified nucleotide with phosphodiester linkages to neighboring nucleotides
  modified_base (9)..(9): 2'-O-methyl modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'-O-methyl modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'- fluoro modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with a phosphorothioate linkage to the neighboring nucleotide
  modified_base (21)..(21): 2'-O-methyl modified nucleotide with a phosphorothioate linkage to the neighboring nucleotide
  modified_base (22)..(22): 2'-O-methyl modified nucleotide
uuagcuuccauuuauucacagg

SEQ ID NO: 1662 - RNA, 22 nt, Artificial Sequence
  Description of Artificial Sequence: Synthetic oligonucleotide
  modified_base (1)..(1): 5'-methoxyphosphonate-4'-oxy-2'-O-methyl modified nucleotide with a phosphorothioate linkage to the neighboring nucleotide
  modified_base (2)..(2): 2'- fluoro modified nucleotide with a phosphorothioate linkage to the neighboring nucleotide
  modified_base (3)..(3): 2'- fluoro modified nucleotide with a phosphorothioate linkage to the neighboring nucleotide
  modified_base (4)..(4): 2'- fluoro modified nucleotide with phosphodiester linkages to neighboring nucleotides
  modified_base (5)..(5): 2'- fluoro modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'- fluoro modified nucleotide with phosphodiester linkages to neighboring nucleotides
  modified_base (8)..(8): 2'-O-methyl modified nucleotide with phosphodiester linkages to neighboring nucleotides
  modified_base (9)..(9): 2'-O-methyl modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'-O-methyl modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'- fluoro modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with a phosphorothioate linkage to the neighboring nucleotide
  modified_base (21)..(21): 2'-O-methyl modified nucleotide with a phosphorothioate linkage to the neighboring nucleotide
  modified_base (22)..(22): 2'-O-methyl modified nucleotide
uagucagggugucaccaucggg

SEQ ID NO: 1663 - RNA, 22 nt, Artificial Sequence
  Description of Artificial Sequence: Synthetic oligonucleotide
  modified_base (1)..(1): 5'-methoxyphosphonate-4'-oxy-2'-O-methyl modified nucleotide with a phosphorothioate linkage to the neighboring nucleotide
  modified_base (2)..(2): 2'- fluoro modified nucleotide with a phosphorothioate linkage to the neighboring nucleotide
  modified_base (3)..(3): 2'- fluoro modified nucleotide with a phosphorothioate linkage to the neighboring nucleotide
  modified_base (4)..(4): 2'- fluoro modified nucleotide with phosphodiester linkages to neighboring nucleotides
  modified_base (5)..(5): 2'- fluoro modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'- fluoro modified nucleotide with phosphodiester linkages to neighboring nucleotides
  modified_base (8)..(8): 2'-O-methyl modified nucleotide with phosphodiester linkages to neighboring nucleotides
  modified_base (9)..(9): 2'-O-methyl modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'-O-methyl modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'- fluoro modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with a phosphorothioate linkage to the neighboring nucleotide
  modified_base (21)..(21): 2'-O-methyl modified nucleotide with a phosphorothioate linkage to the neighboring nucleotide
  modified_base (22)..(22): 2'-O-methyl modified nucleotide
ugagagucagggugucaccagg

SEQ ID NO: 1664 - RNA, 22 nt, Artificial Sequence
  Description of Artificial Sequence: Synthetic oligonucleotide
  modified_base (1)..(1): 5'-methoxyphosphonate-4'-oxy-2'-O-methyl modified nucleotide with a phosphorothioate linkage to the neighboring nucleotide
  modified_base (2)..(2): 2'- fluoro modified nucleotide with a phosphorothioate linkage to the neighboring nucleotide
  modified_base (3)..(3): 2'- fluoro modified nucleotide with a phosphorothioate linkage to the neighboring nucleotide
  modified_base (4)..(4): 2'- fluoro modified nucleotide with phosphodiester linkages to neighboring nucleotides
  modified_base (5)..(5): 2'- fluoro modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'- fluoro modified nucleotide with phosphodiester linkages to neighboring nucleotides
  modified_base (8)..(8): 2'-O-methyl modified nucleotide with phosphodiester linkages to neighboring nucleotides
  modified_base (9)..(9): 2'-O-methyl modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'-O-methyl modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'- fluoro modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with a phosphorothioate linkage to the neighboring nucleotide
  modified_base (21)..(21): 2'-O-methyl modified nucleotide with a phosphorothioate linkage to the neighboring nucleotide
  modified_base (22)..(22): 2'-O-methyl modified nucleotide
uauuugaugaggacgucucggg

SEQ ID NO: 1665 - RNA, 22 nt, Artificial Sequence
  Description of Artificial Sequence: Synthetic oligonucleotide
  modified_base (1)..(1): 5'-methoxyphosphonate-4'-oxy-2'-O-methyl modified nucleotide with a phosphorothioate linkage to the neighboring nucleotide
  modified_base (2)..(2): 2'- fluoro modified nucleotide with a phosphorothioate linkage to the neighboring nucleotide
  modified_base (3)..(3): 2'- fluoro modified nucleotide with a phosphorothioate linkage to the neighboring nucleotide
  modified_base (4)..(4): 2'- fluoro modified nucleotide with phosphodiester linkages to neighboring nucleotides
  modified_base (5)..(5): 2'- fluoro modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'- fluoro modified nucleotide with phosphodiester linkages to neighboring nucleotides
  modified_base (8)..(8): 2'-O-methyl modified nucleotide with phosphodiester linkages to neighboring nucleotides
  modified_base (9)..(9): 2'-O-methyl modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'-O-methyl modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'- fluoro modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with a phosphorothioate linkage to the neighboring nucleotide
  modified_base (21)..(21): 2'-O-methyl modified nucleotide with a phosphorothioate linkage to the neighboring nucleotide
  modified_base (22)..(22): 2'-O-methyl modified nucleotide
uucggaacaagucugcuauugg

SEQ ID NO: 1666 - RNA, 22 nt, Artificial Sequence
  Description of Artificial Sequence: Synthetic oligonucleotide
  modified_base (1)..(1): 5'-methoxyphosphonate-4'-oxy-2'-O-methyl modified nucleotide with a phosphorothioate linkage to the neighboring nucleotide
  modified_base (2)..(2): 2'- fluoro modified nucleotide with a phosphorothioate linkage to the neighboring nucleotide
  modified_base (3)..(3): 2'- fluoro modified nucleotide with a phosphorothioate linkage to the neighboring nucleotide
  modified_base (4)..(4): 2'- fluoro modified nucleotide with phosphodiester linkages to neighboring nucleotides
  modified_base (5)..(5): 2'- fluoro modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'- fluoro modified nucleotide with phosphodiester linkages to neighboring nucleotides
  modified_base (8)..(8): 2'-O-methyl modified nucleotide with phosphodiester linkages to neighboring nucleotides
  modified_base (9)..(9): 2'-O-methyl modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'-O-methyl modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'- fluoro modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with a phosphorothioate linkage to the neighboring nucleotide
  modified_base (21)..(21): 2'-O-methyl modified nucleotide with a phosphorothioate linkage to the neighboring nucleotide
  modified_base (22)..(22): 2'-O-methyl modified nucleotide
uaagcaaucugguccuuggggg

SEQ ID NO: 1667 - RNA, 22 nt, Artificial Sequence
  Description of Artificial Sequence: Synthetic oligonucleotide
  modified_base (1)..(1): 5'-methoxyphosphonate-4'-oxy-2'-O-methyl modified nucleotide with a phosphorothioate linkage to the neighboring nucleotide
  modified_base (2)..(2): 2'- fluoro modified nucleotide with a phosphorothioate linkage to the neighboring nucleotide
  modified_base (3)..(3): 2'- fluoro modified nucleotide with a phosphorothioate linkage to the neighboring nucleotide
  modified_base (4)..(4): 2'- fluoro modified nucleotide with phosphodiester linkages to neighboring nucleotides
  modified_base (5)..(5): 2'- fluoro modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'- fluoro modified nucleotide with phosphodiester linkages to neighboring nucleotides
  modified_base (8)..(8): 2'-O-methyl modified nucleotide with phosphodiester linkages to neighboring nucleotides
  modified_base (9)..(9): 2'-O-methyl modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'-O-methyl modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'- fluoro modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with a phosphorothioate linkage to the neighboring nucleotide
  modified_base (21)..(21): 2'-O-methyl modified nucleotide with a phosphorothioate linkage to the neighboring nucleotide
  modified_base (22)..(22): 2'-O-methyl modified nucleotide
uaguaagcaaucugguccuugg

SEQ ID NO: 1668 - RNA, 22 nt, Artificial Sequence
  Description of Artificial Sequence: Synthetic oligonucleotide
  modified_base (1)..(1): 5'-methoxyphosphonate-4'-oxy-2'-O-methyl modified nucleotide with a phosphorothioate linkage to the neighboring nucleotide
  modified_base (2)..(2): 2'- fluoro modified nucleotide with a phosphorothioate linkage to the neighboring nucleotide
  modified_base (3)..(3): 2'- fluoro modified nucleotide with a phosphorothioate linkage to the neighboring nucleotide
  modified_base (4)..(4): 2'- fluoro modified nucleotide with phosphodiester linkages to neighboring nucleotides
  modified_base (5)..(5): 2'- fluoro modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'- fluoro modified nucleotide with phosphodiester linkages to neighboring nucleotides
  modified_base (8)..(8): 2'-O-methyl modified nucleotide with phosphodiester linkages to neighboring nucleotides
  modified_base (9)..(9): 2'-O-methyl modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'-O-methyl modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'- fluoro modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with a phosphorothioate linkage to the neighboring nucleotide
  modified_base (21)..(21): 2'-O-methyl modified nucleotide with a phosphorothioate linkage to the neighboring nucleotide
  modified_base (22)..(22): 2'-O-methyl modified nucleotide
uuccauauaacuuucguucugg

SEQ ID NO: 1669 - RNA, 22 nt, Artificial Sequence
  Description of Artificial Sequence: Synthetic oligonucleotide
  modified_base (1)..(1): 5'-methoxyphosphonate-4'-oxy-2'-O-methyl modified nucleotide with a phosphorothioate linkage to the neighboring nucleotide
  modified_base (2)..(2): 2'- fluoro modified nucleotide with a phosphorothioate linkage to the neighboring nucleotide
  modified_base (3)..(3): 2'- fluoro modified nucleotide with a phosphorothioate linkage to the neighboring nucleotide
  modified_base (4)..(4): 2'- fluoro modified nucleotide with phosphodiester linkages to neighboring nucleotides
  modified_base (5)..(5): 2'- fluoro modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'- fluoro modified nucleotide with phosphodiester linkages to neighboring nucleotides
  modified_base (8)..(8): 2'-O-methyl modified nucleotide with phosphodiester linkages to neighboring nucleotides
  modified_base (9)..(9): 2'-O-methyl modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'-O-methyl modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'- fluoro modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with a phosphorothioate linkage to the neighboring nucleotide
  modified_base (21)..(21): 2'-O-methyl modified nucleotide with a phosphorothioate linkage to the neighboring nucleotide
  modified_base (22)..(22): 2'-O-methyl modified nucleotide
uuuccauauaacuuucguucgg

SEQ ID NO: 1670 - RNA, 22 nt, Artificial Sequence
  Description of Artificial Sequence: Synthetic oligonucleotide
  modified_base (1)..(1): 5'-methoxyphosphonate-4'-oxy-2'-O-methyl modified nucleotide with a phosphorothioate linkage to the neighboring nucleotide
  modified_base (2)..(2): 2'- fluoro modified nucleotide with a phosphorothioate linkage to the neighboring nucleotide
  modified_base (3)..(3): 2'- fluoro modified nucleotide with a phosphorothioate linkage to the neighboring nucleotide
  modified_base (4)..(4): 2'- fluoro modified nucleotide with phosphodiester linkages to neighboring nucleotides
  modified_base (5)..(5): 2'- fluoro modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'- fluoro modified nucleotide with phosphodiester linkages to neighboring nucleotides
  modified_base (8)..(8): 2'-O-methyl modified nucleotide with phosphodiester linkages to neighboring nucleotides
  modified_base (9)..(9): 2'-O-methyl modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'-O-methyl modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'- fluoro modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with a phosphorothioate linkage to the neighboring nucleotide
  modified_base (21)..(21): 2'-O-methyl modified nucleotide with a phosphorothioate linkage to the neighboring nucleotide
  modified_base (22)..(22): 2'-O-methyl modified nucleotide
uuuuccauauaacuuucguugg

SEQ ID NO: 1671 - RNA, 22 nt, Artificial Sequence
  Description of Artificial Sequence: Synthetic oligonucleotide
  modified_base (1)..(1): 5'-methoxyphosphonate-4'-oxy-2'-O-methyl modified nucleotide with a phosphorothioate linkage to the neighboring nucleotide
  modified_base (2)..(2): 2'- fluoro modified nucleotide with a phosphorothioate linkage to the neighboring nucleotide
  modified_base (3)..(3): 2'- fluoro modified nucleotide with a phosphorothioate linkage to the neighboring nucleotide
  modified_base (4)..(4): 2'- fluoro modified nucleotide with phosphodiester linkages to neighboring nucleotides
  modified_base (5)..(5): 2'- fluoro modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'- fluoro modified nucleotide with phosphodiester linkages to neighboring nucleotides
  modified_base (8)..(8): 2'-O-methyl modified nucleotide with phosphodiester linkages to neighboring nucleotides
  modified_base (9)..(9): 2'-O-methyl modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'-O-methyl modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'- fluoro modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with a phosphorothioate linkage to the neighboring nucleotide
  modified_base (21)..(21): 2'-O-methyl modified nucleotide with a phosphorothioate linkage to the neighboring nucleotide
  modified_base (22)..(22): 2'-O-methyl modified nucleotide
uauuuuccauauaacuuucggg

SEQ ID NO: 1672 - RNA, 22 nt, Artificial Sequence
  Description of Artificial Sequence: Synthetic oligonucleotide
  modified_base (1)..(1): 5'-methoxyphosphonate-4'-oxy-2'-O-methyl modified nucleotide with a phosphorothioate linkage to the neighboring nucleotide
  modified_base (2)..(2): 2'- fluoro modified nucleotide with a phosphorothioate linkage to the neighboring nucleotide
  modified_base (3)..(3): 2'- fluoro modified nucleotide with a phosphorothioate linkage to the neighboring nucleotide
  modified_base (4)..(4): 2'- fluoro modified nucleotide with phosphodiester linkages to neighboring nucleotides
  modified_base (5)..(5): 2'- fluoro modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'- fluoro modified nucleotide with phosphodiester linkages to neighboring nucleotides
  modified_base (8)..(8): 2'-O-methyl modified nucleotide with phosphodiester linkages to neighboring nucleotides
  modified_base (9)..(9): 2'-O-methyl modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'-O-methyl modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'- fluoro modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with a phosphorothioate linkage to the neighboring nucleotide
  modified_base (21)..(21): 2'-O-methyl modified nucleotide with a phosphorothioate linkage to the neighboring nucleotide
  modified_base (22)..(22): 2'-O-methyl modified nucleotide
uaaugugaaaaucacaaauugg

SEQ ID NO: 1673 - RNA, 22 nt, Artificial Sequence
  Description of Artificial Sequence: Synthetic oligonucleotide
  modified_base (1)..(1): 5'-methoxyphosphonate-4'-oxy-2'-O-methyl modified nucleotide with a phosphorothioate linkage to the neighboring nucleotide
  modified_base (2)..(2): 2'- fluoro modified nucleotide with a phosphorothioate linkage to the neighboring nucleotide
  modified_base (3)..(3): 2'- fluoro modified nucleotide with a phosphorothioate linkage to the neighboring nucleotide
  modified_base (4)..(4): 2'- fluoro modified nucleotide with phosphodiester linkages to neighboring nucleotides
  modified_base (5)..(5): 2'- fluoro modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'- fluoro modified nucleotide with phosphodiester linkages to neighboring nucleotides
  modified_base (8)..(8): 2'-O-methyl modified nucleotide with phosphodiester linkages to neighboring nucleotides
  modified_base (9)..(9): 2'-O-methyl modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'-O-methyl modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'- fluoro modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with a phosphorothioate linkage to the neighboring nucleotide
  modified_base (21)..(21): 2'-O-methyl modified nucleotide with a phosphorothioate linkage to the neighboring nucleotide
  modified_base (22)..(22): 2'-O-methyl modified nucleotide
ugauauuggguuuuaaacaagg

SEQ ID NO: 1674 - RNA, 22 nt, Artificial Sequence
  Description of Artificial Sequence: Synthetic oligonucleotide
  modified_base (1)..(1): 5'-methoxyphosphonate-4'-oxy-2'-O-methyl modified nucleotide with a phosphorothioate linkage to the neighboring nucleotide
  modified_base (2)..(2): 2'- fluoro modified nucleotide with a phosphorothioate linkage to the neighboring nucleotide
  modified_base (3)..(3): 2'- fluoro modified nucleotide with a phosphorothioate linkage to the neighboring nucleotide
  modified_base (4)..(4): 2'- fluoro modified nucleotide with phosphodiester linkages to neighboring nucleotides
  modified_base (5)..(5): 2'- fluoro modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'- fluoro modified nucleotide with phosphodiester linkages to neighboring nucleotides
  modified_base (8)..(8): 2'-O-methyl modified nucleotide with phosphodiester linkages to neighboring nucleotides
  modified_base (9)..(9): 2'-O-methyl modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'-O-methyl modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'- fluoro modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with a phosphorothioate linkage to the neighboring nucleotide
  modified_base (21)..(21): 2'-O-methyl modified nucleotide with a phosphorothioate linkage to the neighboring nucleotide
  modified_base (22)..(22): 2'-O-methyl modified nucleotide
uagauauuggguuuuaaacagg

SEQ ID NO: 1675 - RNA, 22 nt, Artificial Sequence
  Description of Artificial Sequence: Synthetic oligonucleotide
  modified_base (1)..(1): 5'-methoxyphosphonate-4'-oxy-2'-O-methyl modified nucleotide with a phosphorothioate linkage to the neighboring nucleotide
  modified_base (2)..(2): 2'- fluoro modified nucleotide with a phosphorothioate linkage to the neighboring nucleotide
  modified_base (3)..(3): 2'- fluoro modified nucleotide with a phosphorothioate linkage to the neighboring nucleotide
  modified_base (4)..(4): 2'- fluoro modified nucleotide with phosphodiester linkages to neighboring nucleotides
  modified_base (5)..(5): 2'- fluoro modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'- fluoro modified nucleotide with phosphodiester linkages to neighboring nucleotides
  modified_base (8)..(8): 2'-O-methyl modified nucleotide with phosphodiester linkages to neighboring nucleotides
  modified_base (9)..(9): 2'-O-methyl modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'-O-methyl modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'- fluoro modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with a phosphorothioate linkage to the neighboring nucleotide
  modified_base (21)..(21): 2'-O-methyl modified nucleotide with a phosphorothioate linkage to the neighboring nucleotide
  modified_base (22)..(22): 2'-O-methyl modified nucleotide
uaucaaaggacaaaauggcagg

SEQ ID NO: 1676 - RNA, 22 nt, Artificial Sequence
  Description of Artificial Sequence: Synthetic oligonucleotide
  modified_base (1)..(1): 5'-methoxyphosphonate-4'-oxy-2'-O-methyl modified nucleotide with a phosphorothioate linkage to the neighboring nucleotide
  modified_base (2)..(2): 2'- fluoro modified nucleotide with a phosphorothioate linkage to the neighboring nucleotide
  modified_base (3)..(3): 2'- fluoro modified nucleotide with a phosphorothioate linkage to the neighboring nucleotide
  modified_base (4)..(4): 2'- fluoro modified nucleotide with phosphodiester linkages to neighboring nucleotides
  modified_base (5)..(5): 2'- fluoro modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'- fluoro modified nucleotide with phosphodiester linkages to neighboring nucleotides
  modified_base (8)..(8): 2'-O-methyl modified nucleotide with phosphodiester linkages to neighboring nucleotides
  modified_base (9)..(9): 2'-O-methyl modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'-O-methyl modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'- fluoro modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with a phosphorothioate linkage to the neighboring nucleotide
  modified_base (21)..(21): 2'-O-methyl modified nucleotide with a phosphorothioate linkage to the neighboring nucleotide
  modified_base (22)..(22): 2'-O-methyl modified nucleotide
uuuucaaguuuagucaacuugg

SEQ ID NO: 1677 - RNA, 22 nt, Artificial Sequence
  Description of Artificial Sequence: Synthetic oligonucleotide
  modified_base (1)..(1): 5'-methoxyphosphonate-4'-oxy-2'-O-methyl modified nucleotide with a phosphorothioate linkage to the neighboring nucleotide
  modified_base (2)..(2): 2'- fluoro modified nucleotide with a phosphorothioate linkage to the neighboring nucleotide
  modified_base (3)..(3): 2'- fluoro modified nucleotide with a phosphorothioate linkage to the neighboring nucleotide
  modified_base (4)..(4): 2'- fluoro modified nucleotide with phosphodiester linkages to neighboring nucleotides
  modified_base (5)..(5): 2'- fluoro modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'- fluoro modified nucleotide with phosphodiester linkages to neighboring nucleotides
  modified_base (8)..(8): 2'-O-methyl modified nucleotide with phosphodiester linkages to neighboring nucleotides
  modified_base (9)..(9): 2'-O-methyl modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'-O-methyl modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'- fluoro modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with a phosphorothioate linkage to the neighboring nucleotide
  modified_base (21)..(21): 2'-O-methyl modified nucleotide with a phosphorothioate linkage to the neighboring nucleotide
  modified_base (22)..(22): 2'-O-methyl modified nucleotide
uauuuuucaaguuuagucaagg

SEQ ID NO: 1678 - RNA, 22 nt, Artificial Sequence
  Description of Artificial Sequence: Synthetic oligonucleotide
  modified_base (1)..(1): 5'-methoxyphosphonate-4'-oxy-2'-O-methyl modified nucleotide with a phosphorothioate linkage to the neighboring nucleotide
  modified_base (2)..(2): 2'- fluoro modified nucleotide with a phosphorothioate linkage to the neighboring nucleotide
  modified_base (3)..(3): 2'- fluoro modified nucleotide with a phosphorothioate linkage to the neighboring nucleotide
  modified_base (4)..(4): 2'- fluoro modified nucleotide with phosphodiester linkages to neighboring nucleotides
  modified_base (5)..(5): 2'- fluoro modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'- fluoro modified nucleotide with phosphodiester linkages to neighboring nucleotides
  modified_base (8)..(8): 2'-O-methyl modified nucleotide with phosphodiester linkages to neighboring nucleotides
  modified_base (9)..(9): 2'-O-methyl modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'-O-methyl modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'- fluoro modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with a phosphorothioate linkage to the neighboring nucleotide
  modified_base (21)..(21): 2'-O-methyl modified nucleotide with a phosphorothioate linkage to the neighboring nucleotide
  modified_base (22)..(22): 2'-O-methyl modified nucleotide
uuccauuuauucacaguuuugg

SEQ ID NO: 1679 - RNA, 22 nt, Artificial Sequence
  Description of Artificial Sequence: Synthetic oligonucleotide
  modified_base (1)..(1): 5'-methoxyphosphonate-4'-oxy-2'-O-methyl modified nucleotide with a phosphorothioate linkage to the neighboring nucleotide
  modified_base (2)..(2): 2'- fluoro modified nucleotide with a phosphorothioate linkage to the neighboring nucleotide
  modified_base (3)..(3): 2'- fluoro modified nucleotide with phosphodiester linkages to neighboring nucleotides
  modified_base (4)..(4): 2'- fluoro modified nucleotide with phosphodiester linkages to neighboring nucleotides
  modified_base (5)..(5): 2'- fluoro modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'- fluoro modified nucleotide with phosphodiester linkages to neighboring nucleotides
  modified_base (8)..(8): 2'-O-methyl modified nucleotide with phosphodiester linkages to neighboring nucleotides
  modified_base (9)..(9): 2'-O-methyl modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'-O-methyl modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'- fluoro modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with a phosphorothioate linkage to the neighboring nucleotide
  modified_base (21)..(21): 2'-O-methyl modified nucleotide with a phosphorothioate linkage to the neighboring nucleotide
  modified_base (22)..(22): 2'-O-methyl modified nucleotide
uuccauauagugcuugcucggg

SEQ ID NO: 1680 - RNA, 22 nt, Artificial Sequence
  Description of Artificial Sequence: Synthetic oligonucleotide
  modified_base (1)..(1): 5'-methoxyphosphonate-4'-oxy-2'-O-methyl modified nucleotide with a phosphorothioate linkage to the neighboring nucleotide
  modified_base (2)..(2): 2'- fluoro modified nucleotide with a phosphorothioate linkage to the neighboring nucleotide
  modified_base (3)..(3): 2'- fluoro modified nucleotide with phosphodiester linkages to neighboring nucleotides
  modified_base (4)..(4): 2'- fluoro modified nucleotide with phosphodiester linkages to neighboring nucleotides
  modified_base (5)..(5): 2'- fluoro modified nucleotide with phosphodiester linkages to neighboring nucleotides
  modified_base (6)..(6): 2'-O-methyl modified nucleotide with phosphodiester linkages to neighboring nucleotides
  modified_base (7)..(7): 2'- fluoro modified nucleotide with phosphodiester linkages to neighboring nucleotides
  modified_base (8)..(8): 2'-O-methyl modified nucleotide with phosphodiester linkages to neighboring nucleotides
  modified_base (9)..(9): 2'-O-methyl modified nucleotide with phosphodiester linkages to neighboring nucleotides
  modified_base (10)..(10): 2'- fluoro modified nucleotide with phosphodiester linkages to neighboring nucleotides
  modified_base (11)..(11): 2'-O-methyl modified nucleotide with phosphodiester linkages to neighboring nucleotides
  modified_base (12)..(12): 2'-O-methyl modified nucleotide with phosphodiester linkages to neighboring nucleotides
  modified_base (13)..(13): 2'-O-methyl modified nucleotide with phosphodiester linkages to neighboring nucleotides
  modified_base (14)..(14): 2'- fluoro modified nucleotide with phosphodiester linkages to neighboring nucleotides
  modified_base (15)..(15): 2'-O-methyl modified nucleotide with phosphodiester linkages to neighboring nucleotides
  modified_base (16)..(16): 2'-O-methyl modified nucleotide with phosphodiester linkages to neighboring nucleotides
  modified_base (17)..(17): 2'-O-methyl modified nucleotide with phosphodiester linkages to neighboring nucleotides
  modified_base (18)..(18): 2'-O-methyl modified nucleotide with phosphodiester linkages to neighboring nucleotides
  modified_base (19)..(19): 2'-O-methyl modified nucleotide with phosphodiester linkages to neighboring nucleotides
  modified_base (20)..(20): 2'-O-methyl modified nucleotide with a phosphorothioate linkage to the neighboring nucleotide
  modified_base (21)..(21): 2'-O-methyl modified nucleotide with a phosphorothioate linkage to the neighboring nucleotide
  modified_base (22)..(22): 2'-O-methyl modified nucleotide
uaacauucuggaacauucuugg

SEQ ID NO: 1681 - RNA, 16 nt, Artificial Sequence
  Description of Artificial Sequence: Synthetic oligonucleotide
gcagccgaaaggcugc

SEQ ID NO: 1682 - DNA, 7665 bp, Artificial Sequence
  Description of Artificial Sequence: Synthetic polynucleotide
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttacagcgccctgcagcgcaggcgacggaaggttgcagaggcagtggggcgccgaccaagtggaagctgagccaccacctcccactccccgcgccgccccccagaaggacgcactgctctgattggcccggaagggttcaggagctgcccagcctttgggctcggggccaaaggccgcaccttcccccagcggccccgggcgaccagcgcgctccggccttgccgccgccacctcgcggagaagccagccatgggcgccgccggctcctccgcgctggcgcgctttgtcctcctcgcgcaatcccggcccgggtggctcggggttgccgcgctgggcctgaccgcggtggcgctgggggctgtcgcctggcgccgcgcatggcccacgcggcgccggcggctgctgcagcaggtgggcacagtggcgcagctctggatctaccctgtgaaatcctgcaagggggtgccggtgagcgaggcggagtgcacggccatggggctgcgcagcggcaacctgcgggacaggttttggcttgtgatcaaccaggagggaaacatggttactgctcgccaggaacctcgcctggtcctgatttccctgacctgcgatggtgacaccctgactctcagtgcagcctacacaaaggacctactactgcctatcaaaacgcccaccacaaatgcagtgcacaagtgcagagtgcacggcctggagatagagggcagggactgtggcgaggccaccgcccagtggataaccagcttcctgaagtcacagccctaccgcctggtgcacttcgagcctcacatgcgaccgagacgtcctcatcaaatagcagacttgttccgacccaaggaccagattgcttactcagacaccagcccattcttgatcctttctgaggcgtcgctggcggatctcaactccaggctagagaagaaagttaaagcaaccaacttcaggcccaatattgtaatttcaggatgcgatgtctatgcagaggtaacactatgcccctttggatctttccttggatttgacttcttttttaaggattcttgggatgagcttcttattggtgacgtggaactgaaaagggtgatggcttgttccagatgcattttaaccacagtggacccagacaccggtgtcatgagcaggaaggaaccgctggaaacactgaagagttatcgccagtgtgacccttcagaacgaaagttatatggaaaatcaccactctttgggcagtattttgtgctggaaaacccagggaccatcaaagtgggagaccctgtgtacctgctgggccagtaatgggaaccgtatgtcctggaatattagatgccttttaaaaatgttctcaaaaatgacaacacttgaagcatggtgtttcagaactgagacctctacattttctttaaatttgtgattttcacatttttcgtcttttggacttctggtgtctcaatgcttcaatgtcccagtgcaaaaagtaaagaaatatagtctcaataacttagtaggacttcagtaagtcacttaaatgacaagacaggattctgaaaactccccgtttaactgattatggaatagttctttctcctgcttctccgtttatctaccaagagcgcagacttgcatcctgtcactaccactcgttagagaaagagaagaagagaaagaggaagagtgggtgggctggaagaatatcctagaatgtgttattgcccctgttcatgaggtacgcaatgaaaattaaattgcaccccaaatatggctggaatgccacttcccttttcttctcaagccccgggctagcttttgaaatggcataaagactgaggtgaccttcaggaagcactgcagatattaattttccatagatctggatctggccctgctgcttctcagacagcattggatttcctaaaggtgctcaggaggatggttgtgtagtcatggaggacccctggatccttgccattcccctcagctaatgacggagtgctccttctccagttccgggtgaaaaagttctgaattctgtggaggagaagaaaagtgattcagtgatttcagatagactactgaaaacctttaaagggggaaaaggaaagcatatgtcagttgtttaaaacccaatatctattttttaactgattgtataactctaagatctgatgaagtatattttttattgccattttgtcctttgattatattgggaagttgactaaacttgaaaaatgtttttaaaactgtgaataaatggaagctactttgactagtttcagagcggccgctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 1683 - DNA, 2294 bp, Homo sapiens
acagcgccctgcagcgcaggcgacggaaggttgcagaggcagtggggcgccgaccaagtggaagctgagccaccacctcccactccccgcgccgccccccagaaggacgcactgctctgattggcccggaagggttcaggagctgcccagcctttgggctcggggccaaaggccgcaccttcccccagcggccccgggcgaccagcgcgctccggccttgccgccgccacctcgcggagaagccagccatgggcgccgccggctcctccgcgctggcgcgctttgtcctcctcgcgcaatcccggcccgggtggctcggggttgccgcgctgggcctgaccgcggtggcgctgggggctgtcgcctggcgccgcgcatggcccacgcggcgccggcggctgctgcagcaggtgggcacagtggcgcagctctggatctaccctgtgaaatcctgcaagggggtgccggtgagcgaggcggagtgcacggccatggggctgcgcagcggcaacctgcgggacaggttttggcttgtgatcaaccaggagggaaacatggttactgctcgccaggaacctcgcctggtcctgatttccctgacctgcgatggtgacaccctgactctcagtgcagcctacacaaaggacctactactgcctatcaaaacgcccaccacaaatgcagtgcacaagtgcagagtgcacggcctggagatagagggcagggactgtggcgaggccaccgcccagtggataaccagcttcctgaagtcacagccctaccgcctggtgcacttcgagcctcacatgcgaccgagacgtcctcatcaaatagcagacttgttccgacccaaggaccagattgcttactcagacaccagcccattcttgatcctttctgaggcgtcgctggcggatctcaactccaggctagagaagaaagttaaagcaaccaacttcaggcccaatattgtaatttcaggatgcgatgtctatgcagaggtaacactatgcccctttggatctttccttggatttgacttcttttttaaggattcttgggatgagcttcttattggtgacgtggaactgaaaagggtgatggcttgttccagatgcattttaaccacagtggacccagacaccggtgtcatgagcaggaaggaaccgctggaaacactgaagagttatcgccagtgtgacccttcagaacgaaagttatatggaaaatcaccactctttgggcagtattttgtgctggaaaacccagggaccatcaaagtgggagaccctgtgtacctgctgggccagtaatgggaaccgtatgtcctggaatattagatgccttttaaaaatgttctcaaaaatgacaacacttgaagcatggtgtttcagaactgagacctctacattttctttaaatttgtgattttcacatttttcgtcttttggacttctggtgtctcaatgcttcaatgtcccagtgcaaaaagtaaagaaatatagtctcaataacttagtaggacttcagtaagtcacttaaatgacaagacaggattctgaaaactccccgtttaactgattatggaatagttctttctcctgcttctccgtttatctaccaagagcgcagacttgcatcctgtcactaccactcgttagagaaagagaagaagagaaagaggaagagtgggtgggctggaagaatatcctagaatgtgttattgcccctgttcatgaggtacgcaatgaaaattaaattgcaccccaaatatggctggaatgccacttcccttttcttctcaagccccgggctagcttttgaaatggcataaagactgaggtgaccttcaggaagcactgcagatattaattttccatagatctggatctggccctgctgcttctcagacagcattggatttcctaaaggtgctcaggaggatggttgtgtagtcatggaggacccctggatccttgccattcccctcagctaatgacggagtgctccttctccagttccgggtgaaaaagttctgaattctgtggaggagaagaaaagtgattcagtgatttcagatagactactgaaaacctttaaagggggaaaaggaaagcatatgtcagttgtttaaaacccaatatctattttttaactgattgtataactctaagatctgatgaagtatattttttattgccattttgtcctttgattatattgggaagttgactaaacttgaaaaatgtttttaaaactgtgaataaatggaagctactttgactagtttcaga

SEQ ID NO: 1684 - DNA, 20 bp, Artificial Sequence
  Description of Artificial Sequence: Synthetic primer
gcttctcagacagcattgga

SEQ ID NO: 1685 - DNA, 21 bp, Artificial Sequence
  Description of Artificial Sequence: Synthetic primer
gaaggagcactccgtcattag

SEQ ID NO: 1686 - DNA, 19 bp, Artificial Sequence
  Description of Artificial Sequence: Synthetic primer
agtccctgccctctatctc

SEQ ID NO: 1687 - DNA, 23 bp, Artificial Sequence
  Description of Artificial Sequence: Synthetic primer
ctacacaaaggacctactactgc

SEQ ID NO: 1688 - DNA, 21 bp, Artificial Sequence
  Description of Artificial Sequence: Synthetic primer
gactttgctttccttggtcag

SEQ ID NO: 1689 - DNA, 24 bp, Artificial Sequence
  Description of Artificial Sequence: Synthetic primer
ggcttatatccaacacttcgtggg

SEQ ID NO: 1690 - DNA, 21 bp, Artificial Sequence
  Description of Artificial Sequence: Synthetic primer
gaccgagacatcctcaccaaa

SEQ ID NO: 1691 - DNA, 22 bp, Artificial Sequence
  Description of Artificial Sequence: Synthetic primer
cccaagaatcctctgcatagac

SEQ ID NO: 1692 - DNA, 7287 bp, Homo sapiens
cttgccgccgccacctcgcggagaagccagccatgggcgccgccggctcctccgcgctggcgcgctttgtcctcctcgcgcaatcccggcccgggtggctcggggttgccgcgctgggcctgaccgcggtggcgctgggggctgtcgcctggcgccgcgcatggcccacgcggcgccggcggctgctgcagcaggtgggcacagtggcgcagctctggatctaccctgtgaaatcctgcaagggggtgccggtgagcgaggcggagtgcacggccatggggctgcgcagcggcaacctgcgggacaggttttggcttgtgatcaaccaggagggaaacatggttactgctcgccaggaacctcgcctggtcctgatttccctgacctgcgatggtgacaccctgactctcagtgcagcctacacaaaggacctactactgcctatcaaaacgcccaccacaaatgcagtgcacaagtgcagagtgcacggcctggagatagagggcagggactgtggcgaggccaccgcccagtggataaccagcttcctgaagtcacagccctaccgcctggtgcacttcgagcctcacatgcgaccgagacgtcctcatcaaatagcagacttgttccgacccaaggaccagattgcttactcagacaccagcccattcttgatcctttctgaggcgtcgctggcggatctcaactccaggctagagaagaaagttaaagcaaccaacttcaggcccaatattgtaatttcaggatgcgatgtctatgcagaggattcttgggatgagcttcttattggtgacgtggaactgaaaagggtgatggcttgttccagatgcattttaaccacagtggacccagacaccggtgtcatgagcaggaaggaaccgctggaaacactgaagagttatcgccagtgtgacccttcagaacgaaagttatatggaaaatcaccactctttgggcagtattttgtgctggaaaacccagggaccatcaaagtgggagaccctgtgtacctgctgggccagtaatgggaaccgtatgtcctggaatattagatgccttttaaaaatgttctcaaaaatgacaacacttgaagcatggtgtttcagaactgagacctctacattttctttaaatttgtgattttcacatttttcgtcttttggacttctggtgtctcaatgcttcaatgtcccagtgcaaaaagtaaagaaatatagtctcaataacttagtaggacttcagtaagtcacttaaatgacaagacaggattctgaaaactccccgtttaactgattatggaatagttctttctcctgcttctccgtttatctaccaagagcgcagacttgcatcctgtcactaccactcgttagagaaagagaagaagagaaagaggaagagtgggtgggctggaagaatatcctagaatgtgttattgcccctgttcatgaggtacgcaatgaaaattaaattgcaccccaaatatggctggaatgccacttcccttttcttctcaagccccgggctagcttttgaaatggcataaagactgaggtgaccttcaggaagcactgcagatattaattttccatagatctggatctggccctgctgcttctcagacagcattggatttcctaaaggtgctcaggaggatggttgtgtagtcatggaggacccctggatccttgccattcccctcagctaatgacggagtgctccttctccagttccgggtgaaaaagttctgaattctgtggaggagaagaaaagtgattcagtgatttcagatagactactgaaaacctttaaagggggaaaaggaaagcatatgtcagttgtttaaaacccaatatctattttttaactgattgtataactctaagatctgatgaagtatattttttattgccattttgtcctttgattatattgggaagttgactaaacttgaaaaatgtttttaaaactgtgaataaatggaagctactttgactagtttcagatcttactaacttcttggcacaaagttagactgtgaaagctgactgaggctgggcacaggggctcatgcctgtaattccagcactttgggaggccaaggtgggagaatggcttgagcccaggagtttgagaccagcccagaaaatataatgggatcctgtcgctacaaaatgtttttaaaatgcactcggtgtggtggtgtgtgcctgcagtcctggctatggctactcgggaggatgaggtagaaggattggttgagcccaggagcgggagattgaggctgcagtgagttatgattgcaccactacactccagcctgagtgatagagtgagaccctatctctaaaaaagaaacaggaaaaaaaaagaaagctgactgaggtgaatgggcaaagccagtaattctgacacctgaccacagctgggtcttctgcataatggacctcctcacccacagcctcccaggcaagcacccatgtttgaaggactatcaagtcaacatgctttttaccaaaagctgcacatttttcactttgattttataaaagaggtcagtaatcgctgaaatctagctgagccctgaagtaaagttctgagcaaagaggtgcatgtgcttgttttatggttggtgaattattacagtttgttttctgcatgcttggcatgaggtgaataattacatcaattttccagagaacctgggccatcaccttccccaacaagtccagttgatgttgaaactacagatagattgagacaaagcgaagtgttcagcaagtagcattactaatgggaccgggggacccgtgggagagtgagtgtacacaggatttaggaaaccatgtgaatatgggctctctgggaatagccaataggtagggagcaatcagaaacccaaggtttggtggctcttcctaggtatttataattagtggcaagtgaaagccttagtcctgaatttctaaccacttgtaagaactaacagccacttctctgtgccccgtccgggcagtaaccatcattctccatggacaggctctcggggtagctagctctgcagggcagcacccacgtggaagggagcacccagaaaccctcctcactgggcagacctgtccttctgtgcctcacagtgtgaggaagattcctgtttgaagagagaagttccagtgacctctagaatctcagagtagttgccaagctttctgtcagtgagatttaaaggccatttacttgtgtttattttatatttaatgagttggttaatgccagagacaaagctgatatcccatttattttggatactgagcatttgcacactattccacttgaaatatagaatcaggaatgtaggccatcccagactttcagatcttacaacagcaaatgacagatgtttgagatcaggccaaaatatccaccctcggtgggcatctcctctgtgtggcaacttatgctgcagccacagtggggagtcacaaactcagagctggaggtcttgaaaaggacaatgtgggccaggctccggaggggctgcctaaaggcttgcttttgtgactctcctgcagaaaatgttagaaacttccaaccgaaagacgagggcagcaacttatacacacgaaggcagaaagaaattggggaaggggaggctgttggaattcaggccgttgtcctatagggagaaatactcctcctctccttctccctttactgataacggggcatggtgaggagatgagcttgtgagggtctgccagtttggtaagagtgcatggggaggttgggtaaattagactagccaaatgggacttcgggaaaccatttatgaggctgtcaccaacagtgatggcaggctgaaattccaggcaagtgctcccagcattccaagagtgtatcaaattaaagcaacccatgatggtggagaacagatacattaaagttccttgaaaatgacagagtggctctcagaccagaccttgattgtgggtataatcggagtgttgctaccacaccctaacactgcatttcccgtgttttattggtccatggaattctgaaagtttgcctttcgggatgcttctaaaaacaattccatggaccagtaagtttggaaagtcctgcgtgcctcacttctcttcaaaggcaaaaggctctggagaggccttcatgaagacatctgtgtttaatgctgcccttcccaaaggtctgtttttgactgtcttttgagaaatgatcctctgatctctaggcagaatgccagtgagccaaggaatcccagttagcaggaggggtgcactcatgggaagactgaagaagttaaaagttcccgccaagtgaaggagacctatcttgggacacttccccttgtcctctcccttgcccctcttgctggagtaaaaggatggaactgggacttgataggttaaaggaggtgtggagaagtgtcttagaccagctctcctgttgtgggccttagggagaagcactctctttcttcgggatcattttccaaacatgcatttttggatggatagggtggatcagggtgagggaagggaaaccaaactctctctaaccttgcccttacagcaatacctgtgatgtaagttacaaaaccacctgtgatgaaagtgctccaggatgcttcatgcaccagggaggggtgccctgtttctcttctgctagcttctcctttcttttttttttttcttcttttttttgagacagtgtctcactctgttgccaggctggagtgcagtggtgagatctcagctcactgcagcctctgcctcccaggttcaagcaattcttctgcctcagcctcccgagtagctggtgtgtctggagttggttccttctggtgggttcttggtctcgctgacttcaagaatgaagccacagaccttcgcagtgagtgttacagctcttaaaggtggcacggacccaaagtgagcagtagcaagatttattgtggagagcgaaagaacaaagcttcggaaggggacccaaatgggctgctgctgctggctggggtggccaccttttattcccttatttgtccctgcccatgtcctgctgattgctccattttacagagtgctgattggtccattttacagagtgctgattggtgcatttacaatcctttagctagacacagagtgccgattggtgagtttttacagtgctgattggtgcatttacaatcctttagctagacacagaacactgactggtgcatttataatcctctagctagaaagaaaagttctccaagtccccactagacccaggaagtccagctggcttcacctctcactgggactacaggtgcacaccaccacacccagctaatttttgtatttttagtagagacggggtttcaccatgttgttcaggatggtctcgaactcttgatctcgtgatctgcccgcctcggcctcccaaagtgctgggattacagttgtgagccaccacgcccggccctagcttttcctttctgttgcaagtcctctcaactagtgttgccttccaccctacaaagcagaattacctcagaagtcctatggccctgactctatctatgtctgcacaaagcactactgtgctttgctgtctgcaagaacagagattgtttgcttcaaccactttctctgaatggatgaatgagttatgatgatatctaaagttacccaatttcaagcaagaggaagaatctggctcggtaccacagatgttcttggaattgggatagtaaaaaagtccctgaggcatcccttggtctgctctgaccacactctcttcacaggaagaggcttgggccacagctctgactataactctgctcttcctccaaacacagctgaggaattgggtggtggggcacctgctcccatgctctgtggcctggctcagagagaagagttgccttaattacattattattcttcctggacaggctgtaggttgtgtaaagtaacaaaaaggactgagaagtgacttcccattcagcctcttccaaggccatttttgataggcaggtcaaattcactcacatttggttatttgttggccagtctagtgcattcacccttgctggtcctcagtcatgctcctttacctttacagagcatcctagactgctcttcctcttaccttccttgtgaaacccacaacccctagtccctccccttccctggcatttgttatgccctctaccaatccctgacctggtattggtcagtctccaatcctggtggatccctgtgggaactaagttaagtctaacttttgtctccctctttagaatttactgggagtactgtaaataaactattgttgttataattatttctgattaacatttttacacctaacaaagtctcagagagattgaatttactgggttgaagggaggagcaccttccacatgacctgcccagcaattaaagccgcttgttagtccgaggcccaggacggccgaggacagctggagagctcttcgttgcaggcagctctggttaacatcaaccgggaaagctctttgtaaacacatgaataattgatcgtccagcgctcacatagctaccgcggatctgagcccgtatgactcatttgcgagccattcctgtcgtctggatgccataacattggaggaatgatgatcgtttcttggaggttcttctgtggccagagttgccaagaccaaggctgtaatggtttgttatgatgacctttgttattccattaggctcaattgctttaaaaaatgatgtgtgcatactttaggaacgtttttaccctttatgttgacctgacatcatagtttatattataaaatgtattaatgacagaagagtgttttcatgtcccaaggacaaattttaacaaccataatctgccctcagtcatcataaatataaatgtattggtcaaacagatctcgttaatgtggccaagataaatgcaagtctatattttaaggcagtcgaagtcctagagaatatatctggagcttttgtggggctaagagatcttgtatatatgctatcaaaaggctgagaaaattaacatgttcccccctctgattttgcattggacagatataaatgtcttggggatgtcaagtaagattgttcacatagtttctggacaccattaatgcctgatggggtgaatcttagttcttaaagctatattctgctcattatgctcacagggcttttgaaaagagaacaaaataaagatttcaagtcttagcaa

SEQ ID NO: 1693 - DNA, 3828 bp, Macaca fascicularis
aaaaaaaaagtggtaagtgagctgtagccctgggtaaattctggaagtgatgaaatggaagaatcagaactttaaagtcaaccattaaaataggggagccattttttcctcttaaattttcaaagaggaattcaggagggagataaacagaaacacatatttggtgccccggagctgcctttccgaggaggatcaagtggtacgtcctgcggagctgtgtcctttacagacagggtgtgacctggggttggaagagaagagaagagagcagaaaagcaggacagataagtgttcaggccagtaaagacagagcctccctgagcacggaactgctctgcagtgagttgccatctggaggagagggttgttcttttctcttggcgaactcccgcttctctcttccaaggcacccttgccctgcatggacaattctggctgagtcttgaaatgtacactcctggctcaggggaccatggctgagctgcggatgacacaggctctcgaccaaacttcagtctcctctgagcccttttcttcgtgaggccttgaccttgccaccctactccctgcagagcccagtttagcaagaatcctgcttagtcagtttccagagtattctcccatccttgatatctgatcatccttgatatctgctcagattcctcatctgtcaccctcagtgtgtaagtccttgcctagttcagtagaatcctgttaagtgggtttatcaagaatcctctacacttgatgtctcctcttagagatttttcattcactgacccccaggaactttgctctttggctataaacccccagcagtcttcgctgtaatacagagctgagcctaatctctttcccctattgtgatgcccctgttacaatagccgtgaatagtcttccttacctttttaataagcgtttgagtaattttttcctttgatagcttggtacatcaaacaggagcctgactcctaaaccatgctgttcgggtgtgctgatattgttgactggaatataacctgatttggaagtgacaagtgactgaggtgagtgcctgcaggaccaggtgacattccctcccgccagaagcagcctggggaccttgtgcagtgctgaacttctgagccaaggccttgccaatgcagctgcagctgaggctccccgccgggagcgtagaaggcgctctcagacgcccattgccgctccgaactgccgctgggagaactctggccttgtctcgctggcgcagagggcctggtagcatcctcctccaccagacccccactctttggaacctccctaaaccctgggcagcctgcggggacggcggccgcagcagagagctggacactgcgcaggccaggcagggccaacccgctctctactattcctgggagaagctgctgcccgctgtctgatttttaatttcaaaatcacgctttgtcctgcaaatgttgtctattgtttattttaggtcaaataaccccataaatacgtaagtaaataaactggtcacttgcagagatcgtgggggagggcacggcgccctgagctgcaggcgacggaaggttgcagaagccatggggcgcagaccaagtggaagctgagccgccacctcccactccccgcgccgccccccaaaaggacgcactgctctgattggcccggaagggtttgggaactgcccaccctttgggctcagggccaaaggccgcaccttcccccagctgcccggggctaccagcgcgctgcggccttgccgccggcacctcgcggagaagccagccatgggcgccgccggttcctccgcgctggccggctttgtcctcctcgctcagccccggcccgggtggctcggggtcgccgtgctgggactgaccgcggtggcgctgggggctgtcgcctggcgccgcgcatggcccacgcagcgccggcggctgctgcagcaggtgggcacagtggcgcagctctggatctaccctgtgaaatcctgcaagggggtgccagtgagcgaggccgagtgcactgccatggggctgcgcagcggcaacctgcgggacaggttttggcttgtgatcaaccaggagggaaacatggttaccgctcgccaggaacctcgcctggtcctgatttccctgacctgtgatggtgacaccctgactctcagtgcagcctacacaaaggatctactactgcccatcaaaacgcccaccacaaatgcagtgcgcaagtgcagagtccatggcctggagattgagggcagagactgtggtgaggccgccgcccagtggataaccagcttcctgaagtcacagtcctaccgcctggtgcacttcgagcctcacatgcgaccgagacatcctcaccaaatagcagacttgttccgacccaaggaccagattgcttactcagacaccagcccattcatgatcctttctgaggcgtcgctagcggatctcaactccaggctagagaagaaagttaaagcaaccaacttcaggcccaatattgtaatttcaggatgcgatgtctatgcagaggtaacgctatgcccctttgcatctttccttggatttgacttcttttttaaggattcttgggacgagcttcttattggtgacgtggaactgaaaaggttgatggcttgttccagatgcattttaaccacagtggacccagacaccggcgtcatgagcaggaaggagccgctggaaacactgaagagttatcgccagtgtgacccttcagaacgaaagttatatggaaaatcaccactctttgggcagtattttgtgctggaaaacccagggaccatcaaagtgggagaccctgtgtacctgctgggccagtaatgggaactgtatgtcctggaatattagatgcctttaaaaaatgttctcaaaaatgacaacacttgaagcatggtgtttcagaactgagacctcaacattttctttaaatttgtgattttcacatttttcctcttttggacttctcgtgtctcaatgcttcaatgtcccagtgcacaaagcaaagaaatatagtcttgataacttagtaggctttcagtaagacacttaagtgacaagacaggattctgaaaactccctgtttaactgattatggaatagttctttctcctgctttgccatttatctaccaagagtgcagacttccatcctgtcactaccactcatgagggaaagagaagaagagaaagaggaagagtgggtaggccagaagaatgtcctagaatgtgttattacccctgtgcatgaggtatgcaatgaaaattaaatagctccccaaatatggctggaatgtcacttgccttttcttctgaagccccgggctagcttttgaaatggcatgaagactgaggtgaccttcaggaagcacttcagatattaattttccatagatctggatctggccccgctgcttctcagacagcattggatttcctaaaggtgctcaggagggtggttgtgtagtcacggaggacccctggatccttgccattcccctcagctaatgactgagtgctccttctccagttctgggtgaaaaagttctgaagtctgtggaggagaagaaaagtgattcagtgatttcaaatggatactgaaaacctttaaagggggaaaaggaaagcgtatgtcagttgtttaaaacccaatatctacttttttaactgattgcataactctaagatctgatgaagtatattttttattgccattttgtcctttgattgtattgggaagttgactaaacttgaaaaatgtttttaaaactgtgaataaatggaagctactttgactagtt

SEQ ID NO: 1694 - DNA, 15 bp, Artificial Sequence
  Description of Artificial Sequence: Synthetic probe
caggaggatggttgt

SEQ ID NO: 1695 - DNA, 14 bp, Artificial Sequence
  Description of Artificial Sequence: Synthetic probe
ccaccacaaatgca

SEQ ID NO: 1696 - DNA, 17 bp, Artificial Sequence
  Description of Artificial Sequence: Synthetic probe
gtcgcaagcttgctggt

The invention claimed is:

1. A double stranded RNAi oligonucleotide (dsRNAi) capable of inhibiting the protein expression of MARC1, wherein said dsRNAi comprises a sense strand and an antisense strand, wherein the sense strand and the antisense strand form a duplex region, and wherein the sense and antisense strands are selected from the group consisting of
  (i) the sense and antisense strands comprise the nucleotide sequences set forth in SEQ ID NOs: 1543 and 1579, respectively;
  (ii) the sense and antisense strands comprise the nucleotide sequences set forth in SEQ ID NOs: 1560 and 1596, respectively;
  (iii) the sense and antisense strands comprise the nucleotide sequences set forth in SEQ ID NOs: 1568 and 1604, respectively; and
  (iv) the sense and antisense strands comprise the nucleotide sequences set forth in SEQ ID NOs: 1553 and 1589, respectively.

2. The double stranded RNAi oligonucleotide (dsRNAi) of claim 1, wherein the sense and antisense strands comprise the nucleotide sequences set forth in SEQ ID NOs: 1543 and 1579, respectively.

3. The double stranded RNAi oligonucleotide (dsRNAi) of claim 1, wherein the sense and antisense strands comprise the nucleotide sequences set forth in SEQ ID NOs: 1560 and 1596, respectively.

4. The double stranded RNAi oligonucleotide (dsRNAi) of claim 1, wherein the sense and antisense strands comprise the nucleotide sequences set forth in SEQ ID NOs: 1568 and 1604, respectively.

5. The double stranded RNAi oligonucleotide (dsRNAi) of claim 1, wherein the sense and antisense strands comprise the nucleotide sequences set forth in SEQ ID NOs: 1553 and 1589, respectively.

6. The double stranded RNAi oligonucleotide of claim 1, wherein the 3' end of the sense strand comprises a stem-loop set forth as S1-L-S2, wherein
  (i) S1 is complementary to S2, wherein S1 and S2 are 6 nucleotides in length; and,
  (ii) L forms a loop between S1 and S2 and wherein the stem-loop comprises the sequence 5'-GCAGCCGAAAGGCUGC-3' (SEQ ID NO: 1681).

7. The double stranded RNAi oligonucleotide of claim 2, wherein the 3' end of the sense strand comprises a stem-loop set forth as S1-L-S2, wherein
  (i) S1 is complementary to S2, wherein S1 and S2 are 6 nucleotides in length; and
  (ii) L forms a loop between S1 and S2 and wherein the stem-loop comprises the sequence 5'-GCAGCCGAAAGGCUGC-3' (SEQ ID NO: 1681).

8. The double stranded RNAi oligonucleotide of claim 6, comprising one or more targeting ligands conjugated to one or more nucleotides of the loop (L), wherein the loop comprises 4 nucleotides numbered 1-4 from 5' to 3', wherein nucleotides at positions 2, 3, and 4 each comprise one or more targeting ligands, wherein the targeting ligands are the same or different; and the targeting ligand is a hepatocyte targeting ligand comprising a N-acetylgalactosamine (GalNAc) moiety.

9. The double stranded RNAi oligonucleotide of claim 8, wherein the GalNAc moiety is a monovalent GalNAc moiety, a bivalent GalNAc moiety, a trivalent GalNAc moiety or a tetravalent GalNAc moiety.

10. The double stranded RNAi oligonucleotide of claim 8, wherein up to 4 nucleotides of L of the stem-loop are each conjugated to a monovalent GalNAc moiety.

11. The double stranded RNAi oligonucleotide of claim 10, comprising at least one modified nucleotide and said modified nucleotide comprises a 2'-modification selected from 2'-aminoethyl, 2'-fluoro, 2'-O-methyl, 2'-O-methoxyethyl, and 2'-deoxy-2'-fluoro-β-d-arabinonucleic acid.

12. The double stranded RNAi oligonucleotide of claim 11, wherein all nucleotides of the oligonucleotide are modified, wherein the modification is 2'-fluoro and 2'-O-methyl.

13. The double stranded RNAi oligonucleotide of claim 12, wherein the sense strand comprises 36 nucleotides with positions 1-36 from 5' to 3', wherein positions 8-11 comprise a 2'-fluoro modification; the antisense strand comprises 22 nucleotides with positions 1-22 from 5' to 3', and wherein positions 2, 3, 4, 5, 7, 10 and 14 comprise a 2'-fluoro modification and the remaining nucleotides comprise a 2'-O-methyl modification.

14. The double stranded RNAi oligonucleotide of claim 13, comprising at least one modified internucleotide linkage, wherein said internucleotide linkage is a phosphorothioate linkage, and wherein
  (a) the antisense strand comprises a phosphorothioate linkage (i) between positions 1 and 2, and between positions 2 and 3; or (ii) between positions 1 and 2, between positions 2 and 3, and between positions 3 and 4, wherein positions are numbered 1-4 from 5' to 3'; and/or,
  (b) the antisense strand is 22 nucleotides in length, and wherein the antisense strand comprises a phosphorothioate linkage between positions 20 and 21 and between positions 21 and 22, wherein positions are numbered 1-22 from 5' to 3'.

15. The double stranded RNAi oligonucleotide of claim 14, wherein the antisense strand comprises a phosphorylated nucleotide at the 5' terminus, and wherein the phosphorylated nucleotide is uridine.

16. The double stranded RNAi oligonucleotide of claim 14, wherein the 4'-carbon of the sugar of the 5'-nucleotide of the antisense strand comprises a phosphate analog, wherein the phosphate analog is oxymethylphosphonate, vinylphosphonate or malonyl phosphonate.

17. The double stranded RNAi oligonucleotide of claim 16, wherein the 4'-phosphate analog comprises 5'-methoxyphosphonate-4'-oxy.

18. A double stranded RNAi oligonucleotide (dsRNAi) for inhibiting expression of MARC1, wherein said dsRNAi comprises a sense strand and an antisense strand, the antisense strand comprising a region of complementarity to a MARC1 RNA transcript, wherein
  (i) the sense strand comprises the sequence and all of the modifications of 5'-mGs-mG-mC-mU-mA-mG-mA-fG-fA-fA-fG-mA-mA-mA-mG-mU-mU-mA-mA-mA-mG-mC-mA-mG-mC-mC-mG-[ademA-GalNAc]-[ademA-GalNAc]-[ademA-GalNAc]-mG-mG-mC-mU-mG-mC-3' (SEQ ID NO: 1615), and wherein the antisense strand comprises the sequence and all of the modifications of 5'-MePhosphonate-40-mUs-fUs-fUs-fA-fA-mC-fU-mU-mU-fC-mU-mU-mC-fU-mC-mU-mA-mG-mC-mCs-mGs-mG-3' (SEQ ID NO: 1651), wherein mC, mA, mG, and mU=2'-OMe ribonucleosides; fA, fC, fG, and fU=2'F ribonucleosides; s=phosphorothioate, and, wherein ademA-GalNAc=

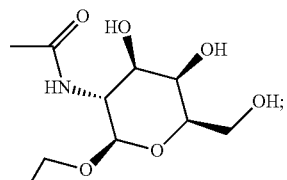

(ii) the sense strand comprises the sequence and all of the modifications of 5'-mAs-mG-mA-mA-mC-mG-mA-fA-fA-fG-fU mU-mA-mU-mA-mU-mG-mG-mA-mA-mG-mC-mA-mG-mC-mC-mG-[ademA-GalNAc]-[ademA-GalNAc]-[ademA-GalNAc]-mG-mG-mC-mU-mG-mC-3' (SEQ ID NO: 1632), and wherein the antisense strand comprises the sequence and all of the modifications of 5'-MePhosphonate-40-mUs-fUs-fCs-fC-fA-mU-fA-mU-mA-fA-mC-mU-mU-fU-mC-mG-mU-mU-mC-mUs-mGs-mG-3' (SEQ ID NO: 1668), wherein mC, mA, mG, and mU=2'-OMe ribonucleosides; fA, fC, fG, and fU=2'F ribonucleosides; s=phosphorothioate, and, wherein ademA-GalNAc=

(iii) the sense strand comprises the sequence and all of the modifications of 5'-mAs-mA-mG-mU-mU-mG-mA-fC-fU-fA-fA-mA-mC-mU-mU-mG-mA-mA-mA-mA-mG-mC-mA-mG-mC-mC-mG-[ademA-GalNAc]-[ademA-GalNAc]-[ademA-GalNAc]-mG-mG-mC-mU-mG-mC-3' (SEQ ID NO: 1640), and wherein the antisense strand comprises the sequence and all of the modifications of 5'-MePhosphonate-40-mUs-fUs-fUs-fU-fC-mA-fA-mG-mU-fU-mU-mA-mG-fU-mC-mA-mA-mC-mU-mUs-mGs-mG-3' (SEQ ID NO: 1676), wherein mC, mA, mG, and mU=2'-OMe ribonucleosides; fA, fC, fG, and fU=2'F ribonucleosides; s=phosphorothioate, and, wherein ademA-GalNAc=

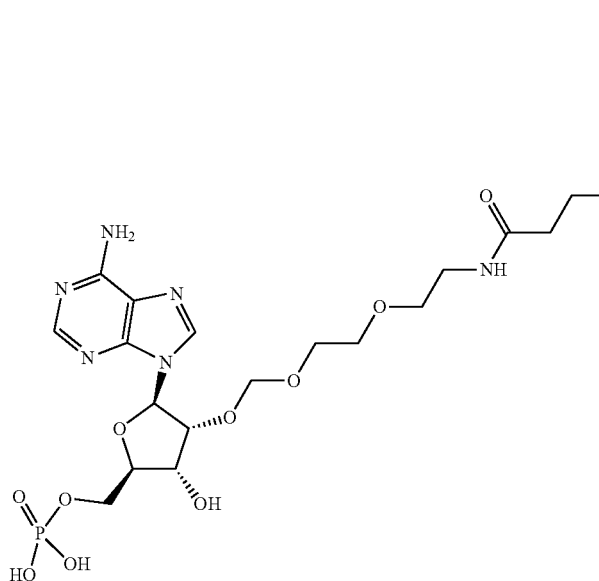

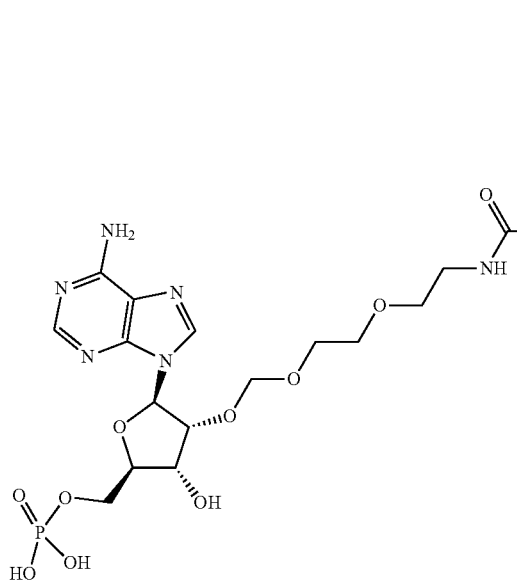

or (iv) the sense strand comprises the sequence and all of the modifications of 5'-mUs-mG-mU-mG-mA-mA-mU-fA-fA-fA-fU-mG-mG-mA-mA-mG-mC-mU-mA-mA-mG-mC-mA-mG-mC-mC-mG-[ademA-GalNAc]-[ademA-GalNAc]-[ademA-GalNAc]-mG-mG-mC-mU-mG-mC-3' (SEQ ID NO: 1625), and wherein the antisense strand comprises the sequence and all of the modifications of 5'-MePhosphonate-40-mUs-fUs-fAs-fG-fC-mU-fU-mC-mC-fA-mU-mU-mU-fA-mU-mU-mC-mA-mC-mAs-mGs-mG-3' (SEQ ID NO: 1661), wherein mC, mA, mG, and mU=2'-OMe ribonucleosides; fA, fC, fG, and fU=2'F ribonucleosides; s=phosphorothioate, and, wherein ademA-GalNAc=

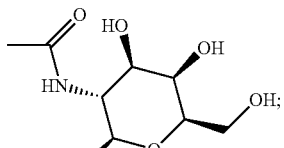

19. The double stranded RNAi oligonucleotide (dsRNAi) of claim 18, wherein the sense strand comprises the sequence and all of the modifications of 5'-mGs-mG-mC-mU-mA-mG-mA-fG-fA-fA-fG-mA-mA-mA-mG-mU-mU-mA-mA-mA-mG-mC-mA-mG-mC-mC-mG-[ademA-GalNAc]-[ademA-GalNAc]-[ademA-GalNAc]-mG-mG-mC-mU-mG-mC-3' (SEQ ID NO: 1615), and wherein the antisense strand comprises the sequence and all of the modifications of 5'-MePhosphonate-40-mUs-fUs-fUs-fA-fA-mC-fU-mU-mU-fC-mU-mU-mC-fU-mC-mU-mA-mG-mC-mCs-mGs-mG-3' (SEQ ID NO: 1651), wherein mC, mA, mG, and mU=2'-OMe ribonucleosides; fA, fC, fG, and fU=2'F ribonucleosides; s=phosphorothioate, and wherein ademA-GalNAc=

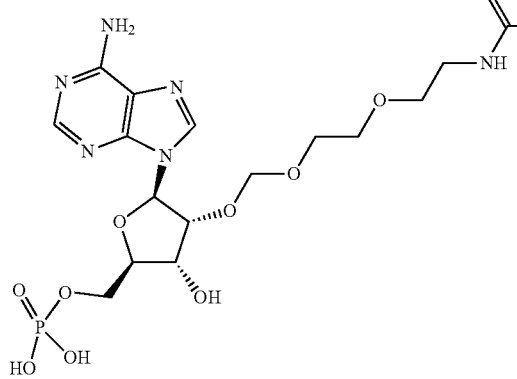

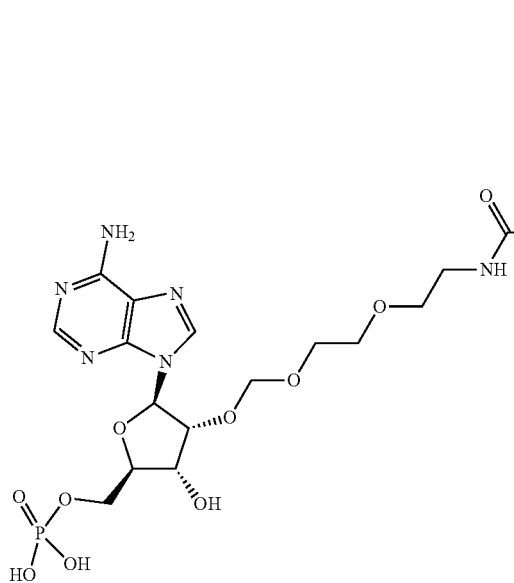

20. The double stranded RNAi oligonucleotide (dsRNAi) of claim 18, wherein the sense strand comprises the sequence and all of the modifications of 5'-mAs-mG-mA-mA-mC-mG-mA-fA-fA-fG-fU-mU-mA-mU-mA-mU-mG-mG-mA-mA-mG-mC-mA-mG-mC-mC-mG-[ademA-GalNAc]-[ademA-GalNAc]-[ademA-GalNAc]-mG-mG-mC-mU-mG-mC-3' (SEQ ID NO: 1632), and wherein the antisense strand comprises the sequence and all of the modifications of 5'-MePhosphonate-40-mUs-fUs-fCs-fC-fA-mU-fA-mU-mA-fA-mC-mU-mU-fU-mC-mG-mU-mU-mC-mUs-mGs-mG-3' (SEQ ID NO: 1668), wherein mC, mA, mG, and mU=2'-OMe ribonucleosides; fA, fC, fG, and fU=2'F ribonucleosides; s=phosphorothioate, and wherein ademA-GalNAc=

21. The double stranded RNAi oligonucleotide (dsRNAi) of claim 18, wherein the sense strand comprises the sequence and all of the modifications of 5'-mAs-mA-mG-mU-mU-mG-mA-fC-fU-fA-fA-mA-mC-mU-mU-mG-mA-mA-mA-mG-mC-mA-mG-mC-mC-mG-[ademA-GalNAc]-[ademA-GalNAc]-[ademA-GalNAc]-mG-mG-mC-mU-mG-mC-3' (SEQ ID NO: 1640), and wherein the antisense strand comprises the sequence and all of the modifications of 5'-MePhosphonate-40-mUs-fUs-fUs-fU-fC-mA-fA-mG-mU-fU-mU-mA-mG-fU-mC-mA-mA-mC-mU-mUs-mGs-mG-3' (SEQ ID NO: 1676), wherein mC, mA, mG, and mU=2'-OMe ribonucleosides; fA, fC, fG, and fU=2'F ribonucleosides; s=phosphorothioate, and wherein ademA-GalNAc=

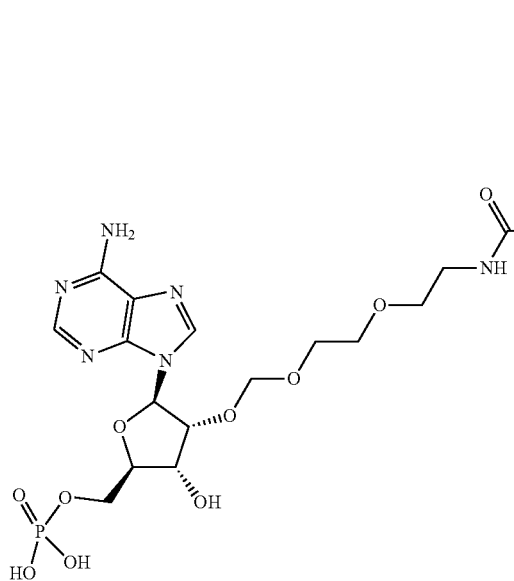

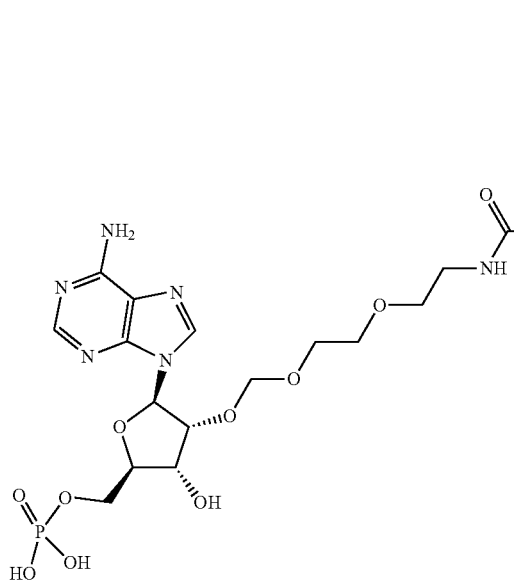

22. The double stranded RNAi oligonucleotide (dsRNAi) of claim 18, wherein the sense strand comprises the sequence and all of the modifications of 5'-mUs-mG-mU-mG-mA-mA-mU-fA-fA-fA-fU-mG mG-mA-mA-mG-mC-mU-mA-mA-mG-mC-mA-mG-mC-mC-mG-[ademA-GalNAc]-[ademA-GalNAc]-[ademA-GalNAc]-mG-mG-mC-mU-mG-mC-3' (SEQ ID NO: 1625), and wherein the antisense strand comprises the sequence and all of the modifications of 5'-MePhosphonate-40-mUs-fUs-fAs-fG-fC-mU-fU-mC-mC-fA-mU-mU-mU-fA-mU-mU-mC-mA-mC-mAs-mGs-mG-3' (SEQ ID NO: 1661), wherein mC, mA, mG, and mU=2'-OMe ribonucleosides; fA, fC, fG, and fU=2'F ribonucleosides; s=phosphorothioate, and wherein ademA-GalNAc=

23. A pharmaceutical composition comprising the double stranded RNAi oligonucleotide of claim 18, and a pharmaceutically acceptable carrier, delivery agent or excipient.

24. A pharmaceutical composition comprising the double stranded RNAi oligonucleotide of claim 19, and a pharmaceutically acceptable carrier, delivery agent or excipient.

25. A method of treating a disease or condition associated with MARC1 expression in hepatocytes selected from the group consisting of non-alcoholic fatty liver disease (NAFLD), non-alcoholic steatohepatitis (NASH), and alcoholic steatohepatitis (ASH), comprising administering a therapeutically effective amount of the double stranded RNAi oligonucleotide of claim 18.

26. A method of treating a disease or condition associated with MARC1 expression in hepatocytes selected from the

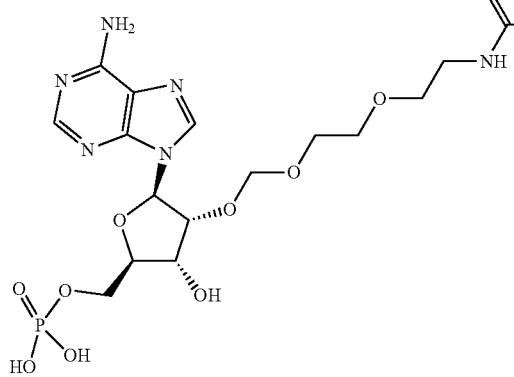

group consisting of non-alcoholic fatty liver disease (NAFLD), non-alcoholic steatohepatitis (NASH), and alcoholic steatohepatitis (ASH), comprising administering a therapeutically effective amount of the double stranded RNAi oligonucleotide of claim 19.

27. A kit comprising the double stranded RNAi oligonucleotide of claim 19, a pharmaceutically acceptable carrier, and a package insert comprising instructions for administration to a subject having a disease, disorder or condition associated with MARC1 expression selected from the group consisting of non-alcoholic fatty liver disease (NAFLD), non-alcoholic steatohepatitis (NASH), and alcoholic steatohepatitis (ASH).

* * * * *